United States Patent 10,905,061 (MADS-BOX DOMAIN ALLELES FOR CONTROLLING SHELL PHENOTYPE IN PALM) - sequence listing, part 2

SEQ ID NO: 27 - DNA, 3391739 bp, Elaeis guineensis (residues 1,695,871-3,391,739 of 3,391,739)
  misc_feature (1)..(3391739): n = a, t, c or g
caaattattatacttaaaaattgtaaaattctcccgaatatcaaaatgcagaaaaattgtattaccagcatcattagaagataggaggagatgatttcaatatgcttatacatatcactgtcttttatgcatgaaaatatactaggagatagcatatatcatatctaattggtgctataactgtctttcatgcatgctaatatcttaggagatacatatattatacttagttattccaatgatattgctacatatacacatataaaggaaccacagtttgtggtcacattgtcaaaggatagatacaaagagatacctacatggtgcttctcagtaaaattatgtgttactaaaactttatcaaagataacattagtgtcatgtctttctctctccctcccattgtccccatataacaattcgaaactcgagagagactatttcgtcgccgcgtctcgttgcattaaagcttgcactcgtcctcctctctctacggtcctccgcgtcttccaacctctctctccaatcccccgtctctccgaggccgatctggggatctcagctctctgcggcaatggacctttcttcgagtctcagctcggtcgcttcgtttgaaagatcggatttttctcatctccagaaggccagatcctttcatttctaatgtttcgatcgcaaacacggccaagggagctcctcttggttcgtttccttctctaaatcgtcggattccattttgtttttctcttttgcaatctttcggtgaatctcgaaagttctgatgccaaaaggaaagtatttgattctatccgatatcttttttccagggtttctcagtttccttcgaagagactggaatttcggggagattttctataaaaaaaagggcttcgaagagttacggatcggtttatctgcatttggttccaggatttcccatcggtttctcttcgaaagtcgattcctttgagataatcgagcttggaaacatcgagtcatggacaagggcaaggccccagtccatggcgaaggtgccggttcgccaccccattcttctcgcttctctgcttctttctctccgttctcgagcaatttcccagagttgggcgatcccttgcgttcatcctcctcgcagcctattcaagaatccagccaagacgtcagcctcatgccggatttcttaccaagaaacctcggccaccgccgagcccactcggatatccttggcctcccagacgacatcagcttctacagcgacctcggtgtcgttggatcccatgatgacatcgatgatgacttgctctccgcttacttcgacaacgagaattttaattctcctcctccctcgtcttcgggcccgtcatgcggtgagccttccggcttggcggcagctcctcctgctcctttgcagactgagaatctggtctcggcttcgaatgagaggccaggggctgggcaccagcatagccagtccatggatgggtccttctcggttctgctgggtaccagcggtgaaggaccgggactgacaccggcagagatgaagaaggctgtggaggatgcaaagcttgctgatcttgctctcgtcgatccaaagcgagcaaagaggtttggctgatcaattgcagtttctcaattgtctttctcaataatatacctctagcattctgaaggtttaccttgaaactaaacgcaattacacttgagatacctgtagcactggattttagtaggtgtcaaacaggtgctagatgttaatctcagtcttcctaggatatgaagaacaaagtatggggtgctaatttagaatataggatacttaaaaggagaagatgtagagcacttaagaaatatccatgcttccattttcccactactcttcaatctgcttccttgcccttaggatgattgttaggtaaaaagaatcataaatccatgtgtcttgataaaacaagatacacagattagttgcattagatctaccatgctagttaatcttcctcaattccggcagttgctaattacatctactgatgttcagaactttcaagtttgtttttcttcatggcaggttcatcatcatctctaatatactattgtatctgtgagtgttgtttggttataagaatctagttccaccatatgtaaaccccagtgatgcaactgttggtggcatcttattacatgacaaccttgttcttgtatgcgcatgcagatctacagctccttgcctccttcctatatttatcatccctaagcttgtgcaccttaactttggcctttaatccaaaagccctagattatatgatgactctgatttcatagacagataaacatgagacaagttgctctttagttttgctttttcagccatttcacaatagtaactgcttttcatagatttttgctattgttaattagtgttattatttggtaaacatttcactgttcatgacattaagaactagttccaggtcatctttaagtaataacataacatccgctcatttttatgtaatctgagatgaccattctaaattgaaatttgcaatttgtgactcttcctttattgtgcatctcaccactacatgcatattcaagttgcatccacccctatcagatgcctttcaaatatctcttcatcattatctgtaagattatttttgtgcagattttgttcagttgtaacagtttatgctttctcacataatcagtcgatgaataaaaagtcaatatgccatcttaaaataataagcacaaaattttcttctgttacacccaaatcatgtatagatctcttgtgctgcaacatctcttcacatgcacctcttctagttgatgtgctttgtagcttgtttgtagatacaacttttgccacttttgctttaattagaagtgtattgaatcttttgaaagatttaatttgtgtcaattcttttgatggactcatgaaaattttacattctttctgcacactctgtgtggagatctcccaagatgatggagagatgtagtgacccaccgatcatgtacacattcatacacaagcatgccaattaagatttaagaccatgcttctttttataattactttgcttattttacctacatgctctatgatgaatagtcttttgctgctgatgttgaatcacatgcttaatattaaagttttaaggatcatggtatgcagttgctaccattatttatgcactgcatttaaagagctccaagtcttgaattcaaccacaataaacagtgcaccttgatggagaatgctcgattattttttatttaatgttcttaataggacattttaagttgtatttaaaataaatatataaatcttccatggtgccaaccagatgattggttctatgtgcattttgtgcccatgcttcatttaccaaaactcctctttcaggcaactaaagttatcctgtacatttaggtccttcatacaagttgttcagatacatcatgtcatagttgttgctcagcatctgcatttttttaaaaaaaaataaaaaagatattgttaatcttaaaatgtgcttaacctacatttatctttcctgttcccaactttctatgtgacgagtattttggtgggatggataggatgtgggcaaacaggcaatcagctgcaagatccaaagaaaggaaaatgcgttatatttctgagcttgagcgacaagtgcagagccttcaaacagacgcaacaacattgtcagctcaattaacaatgttacaggtgcatacatctccataattgtttcatcattatatgtgtgtgcacctgcgtgcgcgtgtggtttgtgtgtatatcgaatttgaaatatgggaaaaaggattctttgctagtccaaaactccaaagaataggagaacttgcaccatcccacccttcactatatatcattccttcaagatgcaagtgagaggcattgattaatcatattgaatatttgaatgtcggatctacttacgtatgattcttcattggcagctgagaatgcaagatgtgaagtttatactatttgatcttatgtaatggttaaaaatctagtgtttaattggatctagttttgcagtgctgctatatactactactacttccaagtccccaaaatcccaatagtaaatatataaataaaacgtttgcctttaagttggtagaactattccgtactaatgagaagttgggaaataggaaatgccatattaaaaaaaaaatgtaagaaacaaaggagatacggatatcttggcattcttacctttccactgttaatttcttcttctttcggcacttgacgcactattcttttgacatttttccttcaagtaacactatattctctataagcttttagacaactgaattgattttatttacctggaatatttactgagaaaactaatagatagggaagtgggatacctgtttcgtataaattgattgttcagaggtcaatgttctatacccatatatcctttattgtcttgagcaattgttatgttacaatcttatatttttttaaggattgccaaaattaggctacgcatatgcattgattagaaaattctcatattggcttgtaattacagagagacaccaatggtctgactgcagaaaatagtgagctgaagctgcagttgcagaccatggaacaacaggttcactttcaagacggtaagttgtttgtttttttttttaaaaatacttttttacatttggtgttgcgaatctcttcttattatctccttcctgggtatgcattgcattttcatttagatctttggttttcagcatcagtgtgaatgtggttcccctcaaaaaaaaaaaacaaaagaaaagaaaagaaatgaagaatctagtagcaatgcacttgtcatttgatctgttaaatttcaatcggtcattcattatagtaacaatggtaacaaaggaagcaacactgacttgaagaaaatagtggtgttttagaagctactgtatatgttcaaggatctccaattttgtcacctctaggaatattagactatttgatattttgacatttttttgacattcaaattttgcttgcttacatatatcatcttcttcctatttttgttgctaaattcttactaccacttcatttttgttatcacattcacatccttgttatttccttcctgggttttcattctttggttttcagcatcggtgtagaatgtgttttccccactaaaaaggaaatacagaatgtggtagtaatgcgcttctcatttaatctgttaaatttcaatcggtcctgcattatagtaactatagtaaccaaggaagcaacgatggcctgaagaaaatagtggtgttttagaattcactgtacatatgaaagaatcttcatttttgctactgcgaggaatgttaacactattccgcatttttgacactcagattttgcctgcttagatatattatcctgttttccaaagcttatgttctttattcgtttagctttaaatgatgcattgcaagaggaggttcagcggctgaagttagcaacaggccaattgatgccaaatggtggtccaatgatgaattttggacacccttcatttggagcgagtcaacaattctaccaccataaccaatcaatgcaatcactcatggcagcccaacaatttcagcaactccacatccactctcagcatcagcagcagctgcaccaacttcagcctctgcagcaacagcagctgcatctccaccagcatcagcaaggacagcagcagccacctgtagacctgaggatgaagggtccaatgacttatcagaacaaaagggcggagggcccatcagataacaataacaatcaaagggagtgaggaaaggtactgggaatcaatagctatccaagtcatatctataccatgtaccctgccttttattagttatagacttggaaccattctcgatatatgaggttcattaagtttgattacctctgttggtctgctttccagaatcatataaatgatggtgatcttccaaacaccaaacaacacttttgcttggcgtggctcaccatttcaataaatatgttgtttcacattatatatcgttggtttattgattcagaatttgtcttggtgaaactattttgtgctagcctgaatattagttcactttgtcaggcatctgagtggtattgaaagttggtgacctagttgggaactaattttattaattactataatctttcttctttcttgtttgatatgtcgtattgttttttttttttttttccctcacaaagtcagctggttgcattctaagcggtgcttgaggctgtttccatcaaatggagtttatcagctataacctcctatatttcaggagggatcggacaattgttggcaatgcccagttcacctttactatattcatttctgcattcttttcgtcaatacagatgctttcaggtctggttggattccaactccacaacatcttttcttaaagaaccatgtatggcttctggggcagctaatagtttgatgtatctgatctactgcaatccacttacccactgccaatggaggtttctcatgatgacaaccctacagaccattccagccgctgcctgaccattctgccttccattttatccacctccgttgatcttgatccaagcgagtgaaagagacatggcccatgtttggttgggttggcctgtttcactgaactagtcaattttagggatgtgagcagcttgtcttttatccaatccaagcaacacagccaaactcaatgacgcataattaagttcgtattttttttatcagattttgatttggatgatccattatgggatggtcaataaatttgataaatttcagaaaattactgttttctgtttctttttctctgcttcattttggcctaaacatcctccaaaacaggtattgggcatccagcgctactgcatctactctctggatttcatccttttctcctgatgttccttatcatgtaattgtggatggatgcttcccatgcaggccttttaagggcgcacacgcacgcacacatccaaaaaaacccctttttcattttgtaaatctagtttcacttgatcgagaccaatattcatagcctacttcacaaaaaataattttaattatccttaaacctacagtctgtatgtgaatgagaaaggaaattgacatgcaaaacaaaatatgaagcagccattttggagaaatgatgtttgatatataaaatttctgttaatacataatacatgtccatgcatttgtgcatgaacatcattatgagattgtccatcagtttttttttttttttttaatcagatatagataacacctaaacctgccccaataaactatagattattgaactatcagaaatatttagtcagatttggtttctgaattattgggtattacttaatgctctactcaattttcaagcaatccatagcttcatgtagttaagttgatgagcttgttcgatgacaaagtctccctcaagcccgcctttcctatggagcagatgttttacattcctgctgaagatggggatcaggcactctaaagcaaactgcataacactcttaatgttgccccccattataatcatagaggtagggaggaccaggatgtgggtcatagattgacagcagggaaggagatcacaaattatcatgcaataagttttaaagagacctcctcgttttttctttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccacagaaccacttaattctattgaacttgaatctgcatcgcattgtacttcatagccccatcacggcagccacagctgtgtattaaattggtgctaatgtaaacattgattcattgctcgagtctagactttctttggatctgtacttgttgaaaatcctgttcacctgttattttacaatagatcatggcatttcacagttggaagcaagtagtagtagctggttggagaaaaccacagcaaaaatgccatgaaggaaaataatgaaactagagaacttcaagcatagaaaataactttctaatttcataattgtaggactacttgttttcctcaaacatctaaagagtttgcatatggaatcaaaattctttttcaaaaacatacagattagacttgactctaaagttatatgcaacttggtggtacatccaaataaagcattattttgtcatcagtggtatctatctagttgccgaaaaatgaaggttgatcgagaaataaaacttatagacttcttaattgtgtccataagatcatcaacaaaattcctggttaagcaaaattcaggtctttcaattcttctaggccataagcttttagtaaaaagcggtttacctgagaatacattttgacaacaaatctaactgtgtttacacccaaacactaattggtcatcaacaaactatagtaaatgttcaaaaacataaatgttgatgaagatttggtcaatcatgtgcatgatacttgaaggaactgtttttggccatttgtcattgatacaagaaataatatgtgggtagttaattgctggaattaacgtgttaaaggaaattatcaggacaagagggttattcatgtaggcaaccactgataaccactaagaagggagtttatcaggacaagaaaccatcagaaggggtaatcattgctgaaaataactgccaatctgcataataatatggaaaagaagcttcatttggacccacactatagacataacaacttgaccatccaggtattggagaaggcttctacaccaccttcgtaccatgacgagtgtgagctgactcagcatccataacatggtcaaaagctctccaatgcaatatcccattctatcttggaggagtctgcccaggcatcaagagtattctgcatcctaaactgttatggatttatatcctatcatctagcacaacaaccgttcctctctggactcaaatgttttctcaattccatctgactgacccacttttcgcaatagacagcatgctctcagcctccagctagagacagtatgagtattacctgtgaagattctatgtaagtgttctatctacatcaaatcttttatttggattgacacaaccagacaggctgacctggacgtgcttatacctagcatttcccccattttaggaaatgaaatacaaacagtaacaagaagctcagaaaccttaggcaacatggctaaggctacaagaatcaacagttaatctaaaaaaatatatagcataattagctaaagcttaattcctctgaaactccttaactatcagttaaaagaagaaaatctgcattcagaataaaaattatctgaatgttggatgcagctaatggcaattctgtgatatcaatctaccatcccattttgacattacgtcatgatagttggaaggagataaaaacaatgaaaggcaatgatccacaagtacagaatggatagcattcattgtcatggctgcaaaggaaactctctttaactatttttcctcaacttttacaatagcacgtctcaaaaacatggtaactggattcaacaacatagagttgctctacctgaagatattgtctacaggaaggagaagaaaaaacacaaaactattcacaagatgccagtatatatccacaagtgaattgtaaattaatgatagtggcatgtttcataagatgaatgcaacatcaaaaacaacatattttgttaattagaaatatgcgactcaccaaaccaaaatctacacttcaaagtaatcgaaaattgaaaagactattctgaaaagatccacatgtcagtctttgagatccaaaagaatttttcacctggaacaggaaccaggtgaaagacgcacaatttctggtttttagaatccatgttctgaccaagcatggtgcttacagcagggaggacctcttggaataagcttgtccaatgaatacagcaccacacaagtctataaattgggcagtgctgacttctagcatatgcacgagcagacaatcttgtatgatggaccaatcatcaatggaaaaaccacatgatctcaactgtaagctatacaagttctgcacctctaccagtaagaatattcatctgcagagttctaccatttccagaagcaagaaagcccacagtaggtagtgaagaatccgtaactgattcaatctcaataaaatttaagtcaaaagctccaccacgcttgaggctcaggaaaaacaccagaataatccatccaagcattgaaatggcccagtaattactcatgccatgaatcaaaccccaagctatggaataaccgacgataattcctgacaagtggccaataaaacttgcttgtggaacaattatggacgtgaaaattaatgattcaaatggtgcaaagctgattggcagagaaagaaacccaaacagattcagctttgaagatggctgcttcactgcaaggatcgtcatccatccaaacaccacacatgagtaaccaacggctgtcactctcctgaaatactccaacttaaacttctgaatcagaatatgataaactcccaggaccagcaatcctgataacactaccagaactagagtataatggagataaaactctatgccaagaccaatgtagcccaactgctcaaccatgccaaggctccaaagagcgctcatgttaaaaaccagatgaaccacgctgatgtgggagaatgcggatgtaattattctccaataatgcccttcaatggctgtttcatagctcaagcccacactggcataaccgatgtttttcttctgaatgtagaaccaaattgcagtgcatattcctatgatacaactagttgcaggtttttcccaaatctcatacaagagtggcttccccatccctcactatccacaaaatttgtgcagcagggctccaacagatcttcagccttatgcaaagccacaatctacaccttacagcaggaaaatgctatcttcacattttcccaagcaatacaaacataacaacaataaatcatgaagtttttgaactcttcctgctcaatcccactaaccaataaaattcgaagagaaatcacttgatatctcgcatattatgaagtctgacttacagctgaggtttcccctgatcaatccagcactccacaattctcaaaaatgttattcaaacaaaaaaaggttgttatatgaggtccaattctcccacatgaacagaaccagagtgaaggataacaaccaatcattcaaatctataaccacactccagactatataaacaaagctccgaacgcgcaggctcgaattcaaaatcctacattcaaaacccaagactgcgtaatcagtcgcaacattatgacttccaacctcagcacataacgttagtattcgtcgtctatatactctacttttgtttggataaaaagaatctctttagaggaattttttccaaatcaacacagctttcacattcttatcttccagacagtaaatcgaattggctgattgaggtaattaagcagttcgattttatgattatatatagaaataagttgcagaaagatcgtagctttcattagatggatagatcacgagaattctaaaggggcggcgggggggggcgggttgaaagcagatcgcatcccctaccttagtttaaaggctctagagagaagaatctatcgaagcgaacaaaaagagaaatcggtgagggagaaaaggcaaaggggaagaggaatagagaatctagggtttcttgatcagagaaatggactaaaagaagaggaaggttttgagatctttaccgtacctcgggtcggaagtccgctgctcgagaactgcctcgccccaaatccgtagctcccttttcctaccgttcttttcttcctcttcttttgcttcttcggggagagcacccaattgcgtgatcattcactgctggtcgttgatcggtgaaccgtctaggctaaccggttcgaccggtcagagacgggctacaaggttcattcagctggacatgagtccaagtataaacatttttgaaagcttgcctcataaataactcaggtttggacaacttaaatttatttaaaaaaataataagctcatttaaactccagcaaaaatgataaataaaataaatttcatatatatatatatatacacatatgtgtgtgtatgtatgtatgtgtgtgtgtatatatatatatatatatatgtgtgtgtgtattgttgcggtacaaatccctaattcatctagctctgcttaagagcaatatgacaaaacatgtccacactgatacgaaatttatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgagctagaatgcatgataacaatcatatttgacctcccctcttatgggcatgaatgctcttaaattactgatgcatggagaatcatctaatcaaatgattttgcaaatgatgtactgataaaacctatatatccactttggtcaagtgattaactcttatctatagtgtacagtcctttacctgattcaataagactggtaattttttgttgtgttacttcttatgtttttaaaggtggtgcaacgataaattatgaaagtaggaaaggcaagaattttacactatttggataaacttgcaatgatgctacataaaattttgatatgctgagaatcatgaatcatgctttctttccactggtgtctgtagcataatcttcttcataaaaacaagcaaatagatgaggactttgataatattttatctaatgttgtttcttgggcagccatctcctttcaataagatatagaatttaactttctactcaagagaatcaattgaagatcccatctggattaacatcaacctgctcttgctgcagctctgtcgatgtatccttcttgcatatgttgtttttttcctgttccatatttagctggcattttctgtcatttcattaatattctgcttgctatatcttgttctcattctcatgctggcagatgcattattcagtggaaatgcataattagctctgactcactcactccaattaaaaatataaatctcacatcatcatgccatgacaaaataaaatcttgcatataatttgatatgtaattccacttgtccaagaatttccatttaccatcatatgtttcccctcttcacaattaaaacaaaaacgactgatgaatccgattcattgcatccttcggagtgttaacttttttgatgaaggctgacagtttttgcagcatcatctattgctaggaagtgatgattagaatttctcaaaaagaactccctgggggctcactgatccatcaaactaccaaattggtctcctccggacaattttgttggatgagagacttgcacaacagccatatatttagttatgttgccagataattaaaagctaaaatagatatttagatcagttaactgctcgcaaccgatggcgaaaaatattagctcttgaagaggagttggaatttggagagagacaatggttactatgactgacatgctcatgccggctcatttgcctcagttccatgcacatttgaaacagaatgcatcaaagagggaggggggggattaaggcaacctattgctggaatttatcaccaaacattccagaggcagcattagctattgtaggctcaaatttacgggcaagctggggtgcatggcatgactaccaaagagccatgttctgtgagaacttgtttacttcactaacctaatctgaaacatagaattcagtccaaaaagaaacaactctgctatttttctgatgtcaagatagcattaataactcctttttttttttttttggctttcaatatgtcctcaaaggacaaacaaaaaatatactatatgtactctttagaagagatcccccattaaagacacaaagaccaccactgcagccaaagccattggcagaaggctaacacgaaggcgatgcccatctcctcttggaatttcatctggcaacgagcattccccaccattgaagaacaccctcgccgggaacccgtccccccttggaacgtctatacccggcgtgcgccgcttcgtgaatgtgatcactgattgttgcttgcccggcaaccttggatccttcgtcgggttcttcccatcggtctctggcatcaggtaattcagaccctccaagccttggaagaagatggtgtttttgggtgtcgtcaacttggtcccattgaatgagtacaccttctcatagccatcataagctttcggcatctgaatagctgagaaccagtccctgaaagtgtactcctcccaattgaatatggtgatcctcgccgaccatccgttccgatagtccgaagcaagatgccagttgatgctaactccacaggtgtcccagcaaggcatggggttcggtagagcgaagtgtttcatcttagcccaagctttggccttggctgttctgttctctgatggaatcagcagagcctccggtggcagcaatgctgcacgggcatcggggtcgcaggtatctgtgtccgggcacccgcaagcacaggagctgcatgggatcgccgagtcgttgtaataggccgagaaggagacgcagcaccgcgatttcttcggtgcaggccttgatatgttgcagaccacctgccaactagcaatggcatagctcttggccatgagaccgctcgggtccgggaactccattgggctcactctgaagggagggccgcaggtgtactccggattgagctggccggtgatcttccagttgtgaggaggatacagcgcagtccggttgaagtcgggcggcatcttgaacacctgaagctgaaagatggccttggacttggttatgtccatggttggtggtaagagggtaccattcttacagcaataaggtatcttgccaatctgtgtatcattggctctctcgggaggcagatcggcgatgatgggcttcttctggcagctcatgacattgctgaagtcgaaatccttgtagaacctcccggccacaccgtagatgcattcggatgcatcatgcttgagggtgtaggcgcctctcatgctgttgatgaattccccacgcttccactcccatgtgaggttccaattgtcgagccggccgagggggtggttgttgtcgagggtcacttgggcaaggtaattgtttccataggcctggagcacatcgtaggcgatggtgaggtcgccataccggcgcggcaagaacttggtgggaggaagcttcttggtcttggatttcttatccttgacgcagcacacatacatctggcttcctgcatagcaatgagaggagaacgaacaagttcttatattatctcaatgctaaatttcctaactaaaaaagatgagatggattcatagttcactttgtatctatatctcttcaatcagatcctcaggtcacactagaatgtcttcgcataggaaagctgcaagtttttagacaaccatatgtttctggttgtattcacaaattccccagtttcacctgcaaactattctaaaatttacaaacatatgaatgcttcaatccttcatcacctccattctagtgcaaacattgtatttttatcaccgaaaaaatgctggttacgaattttgtgtctagttactctaatctgtgcatccagtaactgtaatcaatcagttctaattatggctgctttccagaccattccaaggcatcagggacaagcttccgccttgccaaagtctactaaattttgatgcattttgttgcaccattaggatgaaatctcgagaaccatgcatcagcaattatctgtaaacagttcgatttatgaattccattaattatccatagcttcatcattgagcactcatacaatcaaaaaaaatcatcgaggacataatttatcataaaccatctgtgtttatttgacttcaagtgtcatttgtttctacttggcttctcctatgcttgttttctttaattacactctttctgaaatataatttttctcttattttcttctcctccctggacttttcccatactgtctgtcttcatcccaaattatgacctcgttctttttgaactgatgaatcctaaaatcccaaacaagaatcaacaccaactaggctttcttcaaatctgtagaatgcttcgaccaatcatcccttttcaaatctttcttccatctcatgccaatgcaagccaatgactcacagaactaaatgcgatgcttacctttaagagccggctttgggcacttgaacccatcattttgcagcttgatcgtcttcggcatcggtatccccggcggcttcaccccaaacagcgttcctgttatgtcgatcttcaccatcatctgattcaagtcccctgcagtatcaacggcattcagcaaatctgcctgcggggaccccgaaaacgatgtgccattctccacatgagcagggaagtcggtcccatcggtgatcaccgccccggaagccgacaccaggatctcccggtgctgaaacccgatgaagatactccatgccttgaggtcctccgtcatggtgttgagcaccgtggcggtcgacttgaaggcgtaggattgggccgtcgcattcttgacataagggtattccctctctcgagaaaggaagtcatatgtcaagaagataccgttgcaactctgtgcagccttcggcagctgcccggatttttcatcgccgccgccgtagtcatcgtagtcttgggctagcacgccggtctgaattaggatggagaagaagaatgccgcgaagagaagggatctccagggcggcattcttcttgggctgtctctgaattggtgatctcagagaggagggtggaggaggagatggcgagacatggcgggatttgaggtggttgggtggtggaagggagacgagtacttgtggtgtatggtctttgtgaggggttttgtggaagtggtggtgctctgttgcggcttctcgtttcggatttgccaaaaaaagggtatttggttccggtgaaggagatgaaatggaggacttgggagaagaccttgtcagctttgttctcctcccctcaagttcaaccaacaatttggagggaagagtcaccaacggcccttgacatcttttttgacattaatacctcagcacgtgcaaaccgcatgaccaaatcaagaggaaggaatatgatatattaaaagggctttaatccaaacaatataatctttttaattagttcttttttctcttagattcaagtaactttacaatgataatagatgaagtttattcaatcattctccttatttttatttttatttttattttttttttgagttggattgctaggtaagggcaggtggtagtggtgttggtgttttttttttttcttttcaatttttttcgagtgaaagcagcataaaagttactaggtaaccaataaattggcatagatcaaaaaattttgattttgattttggatcaatgaagttgccaaattagattgcatatattaaacctaaaccatttacatgtttaatataatttttctaaagtgttttttatatagaagaaagaagggaagatatttatctaagtttaaatacttaacaccaaagaatctaattgaaacatctctttagagaagggttacaatcattatgacaatacctactttattgatatatttgatattagaaaattttacataaagatttatttagttattgacttgtcaaggtaaattgatttttttttttttcagaaatgtgcttatttatggctcctcggatgatctggcctttgcatctgagtatgagatatgaaatatgtaaatttaaaatacccaatacatgtattttggataaacaagggggtgtctatgtatttgtttgtgtatagcacaatgggccgagtagctggtggacacacagtcattgctgcaaagaatgcgaagctaaaagacgaaaactttcggcaagtcacccaataggaccaagaccgggcctaagtatcgcgttgaccgtggatgtgtttgcctatccaagtatcgcattggaatattgtgtaatgattggaagattggatctctcttacctccaccttgaactaaagtccagaggatccatattcagatgattgccttgaagaatattggtcggccaccgccccttactgcattaatcatgccatcaacccatccttcctttttaatatgttacatttaaaatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtagtctataaatattatgagatattgtttaaatattatgaaatatttctttgagtttttcatggctatccctttttttcttctttttttaagaggaagagaaggtgaccgtggccttattttttcaaaaataataaagaaaaacataagagtacttaaagaaaactacatgattaattagaagaaaaacaacaacagaaaaatctacaaccaaagaatataggggcttgggcaaaaaaaaagatatgtagaggataattaatataaatagaggataccttccctcaaatggagtagtatagagattgtcaaaaagtgttagtgctattcgtacatgatgctaccaggtcatttttgttaaagagaaagatcttcctattttcaatgaatgattcgattagaatgtaattccctcgtataattgattcagatctttcaaaaaaatttagaaaaaaatagaaaatttggccaaaatagggtttagatttttttttaatttcattgataattaaaaaacaagagtacatatcttctatttaattataatagtgaggtttgtctttgcataatcgaattcggatttcttttctaattcgaacaagattatatttttcaaaaagtagatatggctcctacatcaattttatctttaattagatattttgttaattcttcctaaataaagaggtacccttgatcaaagtttttttcgaatagaaaaattctaatttgaccaaccgactaactatgttacaccctttaagcgatagtgacacatcatagagcttgaaaaattacttgaatttttttataaaaaaatattacctcaatcaagtattatgtcgataagttatggtctccaaaaatttagtatgttactcgacttttcaaaactgtggatcttatttaactatacctctagtcatcaaagtggtccacataaaatttgatgattctcttaaatcaataaatcatcttctaaactatatgtattggtgttttaaaggaaccaaaatcatatggggcggccactaataaagatcatatggggtgagcttcacaatatgccatgtatcccttaatactaatcttaaagtatgagtctaaaagttaaaagtcaaagactttttctactaacggagtcatcagtcccatgatatataactttttctttctttctcattttcagtacataataatacataatatgaccatatgatacaacatctacttttttgatatataactttttctttctttctcattttcagtacataataatatataatatgaccatataatacatactaaatatataatgaagtgatatatattataaatttttttgatatacacacaccaacaatctaatacacacctacagttaaattgatatatagtttatcgaatttagtttcaccagtatagagtatactgctaattgatacacatctctagataaaataatatataattgttaaaacatagcattcatcaatacatcatatatcagtaaatgatacacgctagatgacttattgatatatactgaaagcctttttgatacacatctagtaacaatttaatacacacttataaataaattgatacatagtttatcgatcttagtatttactaatacatagtatatagtcagttgatacatacctaacaaaatattcatccaacatccaaatacacacctctaggtaaaacaatatatagttttcgtaaatttttagatacaaagatcttaaaaaagaagaagaatttaaaagagaacaaagcatctcgaggtttatattggatcattgttgggtatgtatcaaaaaatcttacagtatatattaataagctatttagtgtgtatcatttgtttatatactatatactgataaatgttatattttgaaaactatgtatcactttatttaaaggtgtttattacaatattggatgaatattttgctacatatgtatcaactagtcatacactgtgtactgtgaatactaagtttgataaaccatgtatcaatttagcgtaggtgtgtatatcaaaaaaacttacagtatgtatcatctgattatatatttagtatgtatcatatggccatatagtgtgtatcgctatgtattgaaaatgaggaagaaagagaatgctttaatcacatgactaataactgcgtcagtgaaaaaattttttgacttttaaactcatactttaagattagtattaaggggcacgtgacacattatgaatcccaccccatatgatcttttatagtgcccgccccatatgacttttattcattttaaagatcttagctcccttctgtgaagttgaagttggttgattgccttaatgaaatggatgaggttttagtgttttacccatcccttctttttgtaaagacaaaaaaaagtgccggtgtctgagacatgaaaatccgcattggctttcctcctaataaagatcatagtgttcctttctttcttcatagatagccagtagtgttctcatcatgggtttagactgtaacttggcagtctatgtgacactaacatatgatgaatatcaccctcgtaagccataacactaggtcgcaagcaagttggagcagattaggtatgatattaattctattggtttttaccttttaggtcaaattagatcaagaataatttgagtgccaactagaaaagttggtaaagcttctcgtggtaacgtaagagatctagatccgatccttcttatctctccaaaatttatctaagttttcactatttctggttctcaaaaaatatataattaattatatattaaatatcatacaaaaaaaataatagttagataacatgtagacattgtcaatgatccattttacacaaaattgattgaaagctacattaaaactatcaacatcaaacttgatgatcaatttcagaaatgttattggtaaatgcaaattagttccttagattcagtaattatctcaatgaaacacatatagtgtatgacttccacgttattacagattctaattgagtcattcaatgacccatatccgattcatctttttcttttggacgtggcccaagcgggattcattgaaaaagaagagtgcaaagtgttagcctaggcttaaaaaaacaaggaaacaggatgcaccagtgatctaaatgtatcctattcatacttcagaagagttgcttttctatggattctggatactttagtttataggacttttcttctaatggacgaatgcaagaaaggttggtggcttttgccattctacgtttagaaggcagtttcaaccatgcgcccacaaattccacatccgatttctttgtttggattataatattatcagttgtcgcgtggaggccactcgccctggggtcaataggctatgcctatgtcatgggaatctcctgcatatggactttgaccaggccaatagctcttctcctttggacctttctatgaaccctagaatatcattatctattgatctctggtttgatggtggatcagcattacatgggttgaaggggctgcaaaggtggaagataccttgacatttgacaaagattgaggtggagacttcttccgagcctagctaagtttttcttatgttgtgtttgatagctggcaatctatccatattgctgataatttaatgtagtaatctgaattactacgtttgatatatttttttggatggtaatccagattatcttaataatttaattgaaaatcggattagcaaaaaaatgaagtttagatcatcctcatccctatgcttcaaggattgtcaactgcactaattggcaccctcttctcagctagatatttttggaaacaacaatcacattataatgaattctttttttttttgtgggaggggggaggggtgctctaccatgttaattttatactttaaagaggtaaactttttgttgtaatttgtagcttaaaaattattaataactacatgattgattgctttaaaagaccttcattttttttgtttaattaatatatccttaacttttggttaataacattacctcagctttaatgacagctcacttcatgtgctacaaaaaatgctaattatactttcgtcctttgagatttttttattgtatgaaatttttagtatgatcagatccgccaccaagctagtagaccaattaaacttgaaagcaacactaccctagctccattttccatcctctttcttcattgttcctatttgactgtgttgctttttgattaaactgatccatcagctccacaatcgatttggtccaatcaataatttctcattatgcttccatgagaagatcttcataaagtccgttttctatatctaatgactaatagtttcaaggcatatttttaacaagctcaagatttctattcctccgtaacttcccatattgttgaacttttgataaaaacttgtaggctcgcaagggcctattaagatgactagtatagtgattgattaccaagtagcagtggacagacataaaccttccaagccaaggacattgaccttttgcttcaaatcaaagggtcataattggttttatatatagctgctggatttgatccggtaattctcaaatcttgatccacgggagcctggactcaaaatatttttgctaagctataaaatccagtacgatgcagttcagttgtaaaaaacctttttctgtagggcaagatttttattcttttttatattcagatcagatctcgtaaaaatattttatatttagattagcattgaccacaaagataataagagtctttttaatttgttggatgcaaatttttacggttgaagatagtaaaaatctatatcttttttgttcataattttttttatttaaaaattttttcacataaatctaatgtttacgttaatttttgttcctccaatttttcttttactgacgtagtgttacaacagatctaatgcaacttgggagtcgagacaagccttacaatttgtttcacccacaggctagctgtcttgcaatttgtcgccaacaaacttttaatttttattggtgaaatagtttagtggactgctcacttcaaggctcaaaccattaaccatgtcatgctagccaatagatttattaaaatatatctaatgtataataatatgctaacatgctacaagacgaataacaaataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaccagcggagcagcacaaaggaccttccactttatccttggataaacttgttgaagaatctcctccaagaagatggtggcatcttagaaatttgtaagttggagaaacttctgatttttgaaacttataaatgaaaatgatgaacataaagtagaatgttgatagtttcatactagtgaaaatttgttgctgggctgatgtacttagctggagcattttgatcttttgcatttggataaatagtttatgatgtagataaaacaattaattgagcagaaacttgagtacaaagacaccaaatagatacagctttccctgttttgtgcctaaccaaccaaagtctttgaattgttggcaagaaaataacagattagcataacagcagacctgacacccactggtttagccaataaaactcgctttatcatctgagcttgttcttatgaccagctgctaaaactgctagccctccacaccatgttctctaggcttgttctgaagtcaaccgagcagcttttgtgatgaaatttgtccgcaatctctgtttacttcattttctaatttatctactcaaatgcactgaaaagccccacagattcaagttcgtcataaatatttaatcaaattatcgtagcaatgcacttcggatctcagttcaatgccgtattacagatatagggaataaagcaagagctaatgggacatggctattttgcagtttggaatggctgctgctaaaatgttgctgctgctgctgctcctcatttttatagttagtaagattgtccacaccaggattgaagcaaatgaaatctaccaaaattctggcggcaagctaaccagcaactacttggaaagttagcatttattgtttctgaaataaaacaaaaggaaagcttatgtttgaacttgttatttagatgccaatccaccataaatttattttctcccccagttgacaagaatttttatattacagcaacataacaaactctgttcctaagttaaactaaaatgtcatttttgcttgagttatataatcccattcccttaacatttccttttcaaaaatctacttttccagctacaagttgaaaattcatgaaccaatggctaacagagacaaatcaaccgatcaaccaccccagctttagaaactttatgttgaaaccgaatatccaccaaggcttacataaaaattaaatggcacgaataggattaatttgtaggctatcactcatctttatatacacaccaaaaagtcatgctttcactaagcacccgccaacaataagataggccgaaaagtggtggaggcaagttcttcggtcactactgcatacaaattctgcaaggccagcactgctaaaaaaacaggacaagaaggatggtgaatggcatctagtgatttcggacaacctgaagcttaagaactgacttatcaacagccttctagctttcaatgatgcattctgtaacttgggatgatgagatacccatatcaccaacttgaatatacagtgagaaatggtcagacagatgggtatttgcatcatttgatcattcctactgtgttctggtgatatccagtgggggttctcgtgccatatccagggctcaatccctgactcgaaaataaaccactcccctgtgtccagaatcaagaaaaacattggccaaaaaacaactgctgtacatgaaaatagatcagctcaatcggtgcagagaccaggtgagtaaagaatctctctcatcctctgcaacttccattccatcgccagatctttaacaactgtggccatacttcataaagacatgcacaaaatgaaataggcgatgaaggatgtaagaattcttgctccattgacattagtgcctgcaatgaagataaatgtcaggcaacaggctccaatggaactccagagatgtaaaactccaagttatcaagaaaaactgattatcattcttcaaattaagtgtttttcagaagtcaaataattaaattcactagaactatgtttatgtttgttctttttataaccaaatgactggatacacagacttggtaacttttatgttcaatatgcattacccagactgaccttggcactgttgtttaatcagggatctatagagctgttaatggactggcacatgggcccagttgtttcaggtcatattatgggccatattaaagcctgagctcataaaaaatttcagatttgctcggccaggtgcaacccagtgacagccctagaagctttacttcagtggaacagtgacaatattctcatttgagtatcagaaaatagcttcaactttgctctttgacttcaatctgtgcttccgagatgaaacgaaaaggtcatcatattaaacatcaattcttaatctccacctttccaggtataagaaaatattggaggattgctcgccagtagcatgagtacctggaaggaagatcttcttgacagcctactagcctcccaaggttcatggcaggcctctttcttgtccataaccatctttctcaagtattcagcagtattcataaagaactaaccttactaaacaaaatcttctaactatttcccccaaccacttcagaacctttgcagaacatttcactcctgcagatccctctccagcaccaaattcctaggtgcttccatgacctagacataagagctcaacttacttattaccacatccgaatccgctccattgcatattttgatgtaggtcactaacaggatagacaacccataacaacctcttaacctggacgaatcatactaatccgaaaggctgagatcccatatggatcatataaaggtcgcaggaggttacaatatattcagagaactagcctaatgcagaagtctcatgttgaaaaatcatgtatcatacatgggtaacaaatgttattatattggataacgggacaaagcaagtttaaaattttattacaaaatatgacaacattgcagtgaactgcaaagccttaccagctaacacacaatgtgagctactgcatgaaacctagagcacactaagtcgaaatgcaatatggttataaaaatttaacagagactaaagatgacccaaaacagtggacattgacttgatgagaaactaacgtaaacatgctaaaacaggaagcagtataaattacagccaaaagaagacataccgaagcttccagaagcaggtagtggcaatgcaggcaatgacatttctgcaacatgaaaaagatcacaataacattattatattggcaatgatatctatatatataaatatcaaatgcaaagacaattttgtctagagtagattaatatgaaattttgtctagaatatattaatatggtttgtcaactaccattaaatataacattcctttacggtaatgctaaccaaagacaacaatcacaagagaacctactcaatctattgatgattagcagggcctgacaagtaccagcctaacaagcaggactaatgaaaccctggccaatggaaaagagttacatcctaggaaaatgtgattatggagtccgataagcgttttcatgccgtaattcccaggaagccaagagctattataaccttaaattatgaagctttgcccctaaattctaaattactaacaacataaagtacccatacaacttcactcacccggggcacaaagggacaaggattgaagagaagatgatgaaggccatggtgcagcaatattgtcactcaaatcacatgtaaaactaaaacctgtaacattgtcaaatataatatctgttggcaagctccgaagcagacagcctgcatcgatagtaacatgtttgcatcaagcaaatatgtagatcagctactagcagattgatttaaataaacaggattgaagtttaacaaaccttgttgcccatatgctgtcccagttgcagaaacagatccagaggaaagataagttattagcccttttgcaatactaaaggaaatcaagtgctgtgtgaacttggaatcaaataaaatgaagtgctaagcatgtatttggaatagaaaaagtatagcaaatctaccttgaagactaaaatctttcaagtcgacattgcaaagctcgtatatatcctgttgtaacgccgcctttctgtagcatggacccaaacaaagtagcacagttgatggcttgcttatttgttattagcatttgcctttgtaatgttgcaacataagcatttaatgtattacagcaggaaggattcggagaagctaaatcatggcatgcattgattacatccgagggctctttgaatttcaacggacaaactacaagagaacagacaaaaataagtagtgatttgtgtaccatcaagtatttgtgccacttgaagcacacaacgtaccatatgacgattctgagcatatgagtcataacgtcatgttttctaaaacatcataaatattatcaggggaaaaaaaagaaccagcaacatcatattaagctaagccttagctgcagtaaaaaggaataagatggtccctgctacatcctttctttcccccaaaattctttccctaatcaattaccagaataggaggcaaaaaatggcatttctgcatcccttcaatggtataagaagcggactcagcaacaagagtcaaagtgctgtatgatcatataaagggcatgattcaggacatcttcatgatgttaagaatggagactgttggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggatccaaaaaatcaatgtccataaaaattgttaaatgaacatagagcaaaaattcttctacatcaacgatctaatggtggtgcaacctggaaagatcaaacagagaatactgaaagataaatgatcacttgctgctcatgatcaaagatcagcaagttcagcctattgatgatccacaactgaagcaccaagtaccaagtctcgctgtcaattaatccttcagcagagcaaccaaaggattcaactataccaactagttaatgatcatgatcaagatactatgatggtctattccttgccagttttcagatccatcactataccccatcctaggggtaatgaaatcccatgtgattattaatcattacgcaccagaacaaccatttgacaatttaccatgagaaagttatttgctgatctctgtcttaagcattggagataaggaattcgtacaacaaccaagggatcttaaaaataagatgcatgcagcaaaaaatttaatgcaattttgggttggactaggtcttggtttaactatttcaatattttagatatttatttttgtttgttgattataagttactaggaatcaatatcttagtcctacaattattgctatttttaagttaaactctcccatcagttcaatggatgtggcataaatttttattatttctcttgtaacttttactgaatttaatagcaattttctgggtgattttttgtcatttcaagtgtaagaaatgagtcaaaagactataactctattgcattgattaggctaggaaagtgctaaattattgaataaatctaaaaaacttgttctcagaaaactctaaagaaagccaaatataaattttagacctagattcattaacagaaaaacaaatcagaatctttcaatagatttaggcagactattttatttccatattacttccacagtttttacagcattattgctctattcatcaattagaatatgtttgtggctttatatccgatttagcattaccaacttctaaatttaaaatcaattctcattcaaataagttaagaactatgtatttctttgtagatttaagatgcatctattttgctgatgacaccaaacatagcagacgtaattcggtcagcaactctgcgcttgtttcagcattgttaggactggcataattctcctaattggaatggacacacaggattttatatatttttgattcaccacagtaacctctttcattgatggtattcaacattttaatagattttgcaagggaaactagttttatcctatcccacgaagccatctcctccacttgcatatgtaataagatttactttgtcaactgggaaaatgccatgaacaacatatacaccttaaatatttggcaattcaattcttctagtaacatattatttacttatgggcacctgaatcccactatgagctagatactgcaatctagttctgtttctgtatatttttattttctgccttaactattttttatcaaagcatgagcacaaacgactgatgagcactttgaacggatgcttgagtatgccttatctttttgactattttgttgtagttcaagcatgatgggatgggtttcaaaatgagtctcaacagaacaagagttccatgcaacattgtggatttaagtttcataacatcataacattccaataaaactgaacaaatgaaaatgaatttgtaaaatttaaccttttgcatcattttcaccttaatgttcaagacaagactttaaaaaggcaacaaaaaaaaggtatgagccattattgagttacaaatgagccacaaatcaaacagatctgtaggaattaaagcttgctgacttgcatggaccatggcatcttaatttcaggaacatgagctcctgatcgccagcaagaaaaaggtctataagcttcatgcatcagctcagataaaggaaccaaggaaaagaatgaaaggaggagacgagatggaactcaagtcttatttcctgctcaatgttattgaccactgtttggttaagattataagaaaggcaaaaaccagccctttctatatatttaatgcaagagatgagacattaatagccccaagacacagcttcttcttccaataatattaaggtttagccgaaaccaaatagctacctaccttctccatgttatcctaattattcaaaagcttatttgattgccagccctctaaatggctccatcactctcccaaacattagacccaactcttgatctgcaatctttcaccttctgctcaagagaccttaacaagtagtccccaacaggtcgtatagaacagagctacagttggtagctaagcattatattgtggcaatgaaggaatagcagactatggactttaccatccagtgagggtcctacagaagataaaacaattacagggtcattacaatgtgatgtataaatgtgtgtctccatacatgcgtataccaatggttttctcaatttcacaagctttttttaatcctgtcatttttttgcactgtcatcgctctctgcaacattccaaaacattataatctatgtgcaaaaagtatgcagattatgtattgatatcttatggtaaagaacaaacatatttgcagagatgacaaaaaggttactatcattagcaacaaacatagcatatagacttcttacaaataaattaggcaacttacctttgttaaccttacagctagataacatccgaaatgcactgttagcagcctcaggcaaaagcttcctggaaagccatgcataaactactgtcttacagtcatttataacatcaaccccaacaacagccccagaaatattagaactgtccgcaacactagctcctcctgatgatatgtgaagtgcagcttccatgattgcaggctgacaactaggcctacagcactccttaagtgggtcaatagtactgcaggcatctagtaatttgcttgtgtttactgctttctcaaaggatttagcatccgttacaggacaagaaccaccagtgagatttgaagacttcaccgagcacagggtagggatagtgctgtttgcccctctgctgactaaaatacttataatatctgaaaaacaatcatttgcagcagcttgatgaagaactaatgcattagatacattgttgtaggcacccagaaaaatgtgcattaaactattaacctgaggacaacaaattgcatttccaataagtgcagccaaaggttcagcacaatcagatgccgtcctgtctataatacttgaaatagaagaaaaattcacagggcatctcccagtcaagactggttcatatgtgtctggaaatgaagggtacattggtgattgtggttcaacaggatatgggttaggtggaaccacagcaggtgaaatttctatgggatcaaagagtccactaggtgggtcagacagaataaatttgtcgggaacatgagacttgggttgaaaagttgttttctgcggcactacatcttgcaaaccacatatccagattgtaaatattaacaagcgataatacgaaggccctgcaacaatataagtcttttctcagcaccaaaatctgagagttacatatagaggaaaacaaatggcatctagcttgcacagcgtcatttgcataaaaaactaaagaagttgaattttgctgcagtcacctcatgtcaccatttatttttactcttgcacatgcagtgatacaacactacacaaaacatgtttaatgtaatgcagtatcatgcttacaagttgagcctatagcatgaatggatgcaactctactctaccatgcctaacatcaatatgcacgcctccatatgtatatgacagactatacctgttaacaaagttgtaagcttgaattttaaaagagaaagttacaatagaaccatccaaattttagtgtggaaataggaaatctttgtaagtctatgtggttgctgagaaagtgaaagaaaagaaagttatgaaaaagacaggcagaagtttctctcaattaagccaattattttcttctcaaataggaagtaattttgagaaagaatgacaaatgaggcaagtggctacagataattcaattccatacaacttctttccatttctacccagtcaatcaaacataagaaaaacatcaactttcttttcttttctccactgagtcgcttttcttttgttcattttctcagaagccgacagaggattaagggtacgataccattatccatattccctttttaatgatatgaatggatcttatattttattgcatatattgtgaaaacttgattggacatcaatagaaacacttgttactttgaatggaatgctcattttgtttcttggaggcctaaatattttcatccatggatgtacgcttgaacatatttatgcatgcatatttgtagctttatatgctgcacagatataagaaaatatattacatgaactcaggtattcgcatgcctaaggcacatgtagttgttagcatcaacatgtttcccaggcacatgccttacttttcttagatgctatggagtctgtgtttcccaaatacctttgtttttatgcatctttgatttcctgaatattatgcttatacacaactatgcatttttcctaggacaacagttttttgcatttcccaagtggatccaaattttctaagctatgtactagtgtaaccatattgatggaaatgccatagtacactcatcttattgcacgcacgcacgtaaaaaattttaaatcccatagggtggggctatccgatttgcccatggaacaggatgtgccaccatctcagcccatcctaatgctcaggacatgagatatcccaagacatgccgattgggacgttgggacaatgacgagacgatcctgtctcgacacttggaatggcacccgattagttgccgaataagatttattttttaaaaaaaaagcattattgaataaaattgacaaacaaaaaaaattcaaaaactccagacactcatttttggcatttttgtatataactcccaccccccattttagattaattgcacataacaacccctttttaacaattgacatacttgcaaattgagatttcccttatctcaataattacccaacacgatcgcaagctaaatttcagtaagcaataaacatcctcacaaagactaacatccaaaaagtaacagataaaattaccctcattttctctatagccatatgcagccctaccagccacagttataagtcaacgatcccatgtctcaggactctcctcactcacactcagtcatttggagcttgcagttactgatctacatgtactcatggatgagatccctgcaggttgcagctcctccctagtgccataattagggttaaaatctcaattcttgttatcagcaccgttggagtcagcttctagccaccaagaaacattgggtctcaagctcctagtgaacatcattattggaattgagctctttgatgcaaccttaactagaccatggttttaatttactcctcataagaaaaactcatcaatcaccatgacaaaacccaggaaataagacctgttgaaaattttctaaaagaaaggtaaaaatcaatctcattatgattcaaacacctgataattagccgacaaatattaattattatgagaccggcatataagaagtctaaaatatttcctttattctcatggatctggtgagaatctcgtcaagttatcccaggcaaaaaaggatgactcatttggaaacacaaagcagatatggaagactgatccaagtaccgctaaaaccagatcattcgagtagagtaagctgtctgaatttaaaatgtataatgatgtaacaaattgtagagataaaagcatgacaaaaatgacaaggaaccccggaaactaaatatattaacatagccttgggcagtttaaagaatttggcagaataatctcagtttatgataaaacctaacaccacaaagcactagagtcacagaccgattgtaagtttccgaccactcaccctgaaaaaaggtggcaactttgagatgctccatacgggcaatatcccctcaacccataaatgattcaagcctaccgcttcgcaatttagagctccagcactgtgaaatattcagttaaaaaatttaaaaattcgagcacaaggatttcatcatatcaaatcgacagttagcagcgagattggtactgaaaaatacaaaaatcagcacaatgtagttatcaaagatagataaataaataacataaacataaacatattgataaaacaacgagttcaagaaaacaaatagtaataaaaaagagatggattatcagaatattgatgcttgtttttgtagcatggattgttggatattttaggaccaatttggtggtcgtgagaacaaaaatcggtgagagaaaaaaaaaatgttacctcttgttttgtttctttccctattttatagatcgagctccctcgtgaatggacttcgattcggaatcggttctctctctatcttgcttcctggtttcttctgtcccaaatgtcgctctcggggactcgccctcttcttctgctgttctcaacctttttaattttttatttttttttatttttttatattctttttttgcttttcctgcaccggctttctgagctgctttccttttgctgtgctttaaaacaaacaacacctgcggactccacaccgcaatttatttcggttctttccgattgtcccctctgagttaccgaaatgcccctcccccccccaggcacgtgtaatgcgcgtgccgcctcactatggaacgaactttgacctgacttgcagagaacatggagcaaagacaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaactagattttataaaatataaaatgtagtattgaataaggactcagcatgctatatcataatattattagacaaggtttttttttacctatattttgatatttgttagcaaaaataaattttattatgtgaaagtgagatttataaatatttatttattttataatttcaaaaatttaatatcaaataatattaaaaatgaataaatttttttatttgcatacattatatatttttattattttagaataaattgattcatgatctttttatttacacaataatttaagtgtagtatgaatatccatatgatttataaagtaatatgcaaaacaataaaattttgatctttaaaactagtcagccatgtccttgaaattgcaccaacaaggaccacatctatccagaaaggcaacaagctctttctctttcaaccaaaaatcattaaatgagttttttcctttgtaatcatagaattactcttttttacccatccctgccttcatttaccgttgcaatcgcccattgagggagagagagagagagagtaattaacagagaacaaagaaaaatctccattccatctctcgtaacaccaaaatttcaccaatcatataatcagacggaccacatcaaacgcccttttctgcgcatactcgacccatctggtcgactcgcactggatttctccagcgagcaaaagaggggaagaaataggggagcagcagcagctgaaagagtttcactgtcgcaccacagaggcgaagacgacgacgaaaccatgaagagcagcagagacgaagaagggaagaaggagatgagcagcggaagctccagcccaaatctcgaatggcgattcaaccaaaccctcaggaacgtccaagggttcgtccgttcgatttcccgtttttctccatttcaagatttgatctcttttgctttctatagatgtcaggagacctccccataactaaattcggatcttgaaaacgaatgctattgatattcccttcggttttaggtcagatcggaatgtgttgatgggttttgttagctttgcgttcctgcgatcggagattgcataaagttgggatcttgatagattttgatggaaaattcggagaatttgtctagtttttgtgccacaacgaattatttagtgtctactgaaatgaattcactatcagatctgccgatttatgtcagcttaggattgctttcatgttgttcacttcacgtgttctgatggaatctaggactgacactgtctggttgggtagttgtgtgtgttttcctatttattgctggtttgttgtgttattgtttatctgtaaaggatcgtcaagttctgccttgccgttggggatttcagtgtttgtctaaattcgtagttagggactttacgcagctgttgtgggtttcttcatctaataactgaagctatgttaatctttcatgcgagaaagaaaaaagaaggaaaaaaaaaagaagataacgatttcatcatgtaactggaaaggctgtatgtctgatctggagagcttgaatttccttttctgtggttgaattctattacgagataaaatggatgctgctatattcatctactagaaaaaattagtagtggttgtgtttgatttttatgtgactccaccatacatacttataaatttgacgtccagtttttcaccttcacacaataattggactgctcaggctacaattctctttccccttaaactatcttttagtcatgcatgcagagagacttaagtatcgatagtaattccttggttagttttcttgatgcttgatgtattatgcctcgtctagccagtttattgatatattagaacacaaaataccactttttgacactgaatcaggcaaaaaaaaaaaaaagaatcctcactcctgtcataaattggtaattttgctagttattacattaatgaaactagagttcttctccccctttttttgggcattacaacctcttagtgggcattatggacttcagtttggaatcctttgttcatttggactaagaatatttataatatttcctttttgtccaggatacttaaaggccgcagttttcctggtaaggttttgctaacacgcagatctcagccaatgaatgaatgtgcctctcctgaacactctcaaggcattgaaagaagatactctgaaactgatcgtgagcaaggtgaacatgctgacaggtcttttgaggtaataatgactctatctacatgtatttacttttaaatggatgcagcactcggatatcttgatatatcaatgacatcacaacacagggagaagttcagaattcaggcagcacaactaataataccactcctcaaaactctagtacatcaccatcaaacaatgcaagtacatccccagagctccagagatctgtttctgcggctagagctacagattctgcaagacttaccaaattcagaaaggaattgtctagaccagctgtcatattaggtatattttattgcttctgacttgttggcgttgcttccagatgatggtagcagaataaatcaaattgagcaaatcacatcctagttaggttttctgattttccaataaatgacatttgtctcattatttgatttggttaggctctttctatgcctttttcatggaagatcctcttttattcttgatatgtagttaagatcccgtttttattcttgatgtatagttaactttggaaagaaaaatggtactgccctattaacgactaaatcgcagctgcggaaatgacttaatttatcatggatattatatgtatctctatatctttagatatgcctgatgctagcagtcccagctgttcacaaataatgagctaaacataatggatgcacaaatgaaaaatatcaggttatatcgtttagcttcatttataacctgaaggtgttggatgtgctttcaaactgactcatggtacatacatgatgcacaaaaattgtaaattatatgataagcaagcaaatttgacacattatggaaaggagcattgcagaaaaaggatgacgccagctagttctcctatatagttaaattgtagttttaactggggacactgcttaatcatatgtaaattacccgatggagattccacgaccattcttttcttgagaaattatcatgtatagaattttgatcaaaaggttccccacctttgcttttggagggggcttaacatagaggaagttgtgacaaagagtatgagacaataccaaatgaccaagatgaagcatgatgactatggttattttatgattcactaaataaacaatgaccacttattatttataatacagaggctgtcccagtgcacaaggctccctgactacagggtcaagagaggcaaatgtaaataaagaggctgtttccatgtttcaaaccataacacctaagtcacaatggagcaaccttaccattccaccaagacctttcctcttaacttttttatgagctatgaatcccaaaattatctaaattgcccctaattccaaaacatcaagctagatggtcgaacatcaacatctcaaccattgaatttttcaacactagcccacaacctcgtggtgtctaagttccatattgttctgtctttctctctatctcattttgatcatctagaacatccttttatgcatcccatggtgaatatctgtatcttatttattccttacaataaatttggatctatatcagtttaatttgtctcataaaaaatagttttccttttaaattaatctttgtaactgtttgccctatgatcgaatttgtttggagcatctgacacttaagaaacacaatcatccttttgtttaacttcatcaatgttctactcaatggcaatattaaaacttatcatttaagctattttccatgggttgggcattgaatataaagacgtgatggtatgatcacatcccgcacttaccccctattcctcctacagtacattaggtgggagttgctcatttatgtagcaagtataaccattgtaactttttgacccttgaatgcttctattgttcctaattttttggtattctaatgtcttctgttgtggattggtatttgcattcgcttagtttagtgatattttttttcttttaaaagtacaaactagtacctgtactttttagaactgaataagcttttatttatatccttacattgtctatgtggcagagaaattacgcgaactatcttggagtggtgtaccgccatatatgcggcctgatgtatggaggctactgttggtaagtgaccttccatgattgtgcaaattcattgtactacttatgcaatatttatggagcaaaacacaaaaaatgctattctcttctaggacactaacttcaacaacctacttgtgctatgcattgacaatatgaaattactacagatgtgtttcgattaacaatgatatttgacttactcttagagggaacactatcatgaatttctgtttctttcactataaaagcacaaggtaaaggtatacatctttcatggtgaccagtttttgtgactcctattgagaagtagtcatgactggcggtatggattaggcctgactggagcctatattttttttatttctgacctatgactgtgatcctcagacctggaatgttattgcccttttgtcttagcagccaggcaatgaggttttcaagcaaacattgcatttgaatcaccttttgcaaattgattgatctgcctatatatgcctatatgcattgatgtttggggctaactcaactccccaagtgagtctgctgctgctgtgcagaaaacttgccaagttgaacccttaaccagattttggacttgtgattctacttcaggattactcatgttcagattttgttctttcacattatttttttttcctagtaactggttttgtcaaactgaagtttactctcaaaatcctagaatgaagaacaaatttatccatccgttgtttggtttggctttaccatcgagttcatctattcttaaggcaaaattcacttgaaggacctcagaattttaataatatatggtaacgtgttcatcaatctgattgagatttgttcttgtttgcaacatctgagttgagagttccctctttgctccagtcctatttctcccttcagaaaaaggtcccacagttttgttgttgtagtccttagttttaatcttgttgaaaagcaaaaataaggcactcagacatgataataatattatcatttattgttagcacaatagaaaaaaggctgacacgaacaagcaccgatagatattttagtgtaaacatgctcatgtcatgttttgaccctgctcatgacacatgtttcatatattattcgtgttctgcttcctggtttatgttcttatatttcaataaaaggcattcctactcaaactttttttgtgttataaagaacttcaatattaggcattagacacatacatgcaaatccattgttttgtgggagaaaaggctttgcatctgagcctgacctttcatctgcttgatctaatggttaggcttcttctaagtacgaagccacaatagaacaagtgccatctctgcgaatatttgccaatctaacatccatgctaattcaatccacagaagcaaaagttgtgcattacctatttctcaacaattcttttggggtgcatagggtaaccaagcggtcccataaatgaaccaccattcttgtccattattagggatatgacttttctctagtttctgaatagatcagagcatggactcaagatccaagctcggtactgggtactgtaccagtaggttactggttcggtacagtacatgaagaattatagatcacaataatcaaaatagaataataataatagtccagggtggatgtatgaaactttattcactaatttttctccgacaagggcatggttttttttgttttttaggttactttaggcattcaaaaacttaactatggctggaaaatcccatatgttgcctcttctcagacaaccatgtataaaattgatgtcaatgagagctgttctaccttgtctgaagcagcataaagaataaaaactacgattttgactaaagctttgcaactagagcttgggcatattgataacccattcttgttggcaattagtatgctgtttcatcttttgctgatggatcagcaataaggcaaaaactgtatctgagaaggaaaacaaacaaggagatattgaaatgaacatttggagtaagtttataccttcttgggaaacttggccaaccaaacctggagtgagtgaggcgcattccatgtagttggcaggagactggtgagaccaaaactctccctccctctcactaacaaactcaaacaaacacttctatccatgccttctttgaattgtgctgtctacttggagagaaaagcatcaactagaacatgttccttttttttatttggcactgaggagaattccaagatttggactaatcaactcctcttaaaacatagcatgagcttcttcttttttttatctttttgtttattaacaaactcgcaatgggcatactggtttgattttttattggttctaagaaaatcaagctaccttttgattcccacccattgaacattcacagatttagttcgctgtcccagtactagatcctgtaatggtaccatactattgcagtattagtacgcggtatggtatgagacagcatatcgactgtcggtatgatatgagacagcaatatcaggtgatatgaggtgggacggtaaaccatggatataattatgaacataccatgcggttattgaagccccttcagcttttctttgcctttatccttggatttctgctctacttaaatggtcttactagatgcttgtaccagaaactacatttttatttataaaaatccttctccatgcacttgtgtatattgaatgttctgttgcataattgaaatttaaatatcagctgacaacagggatatgcgccacctagttcagatcgacgcgagggagttttgaccaggaaacgacttgagtatgtcgattgtgtttctcagtactatgacattccagacacagaacgttcggatgatgagatcagcatgcttcgccaggtttcttttgagcttctcatattgttttttgatttctccatcaaatgcatttagaaggttttctgactcttcatcatgctattccttctttggtgatcagattgctgttgattgcccaagaactgtacctgatgtccctttcttccagcatgaacaaattcagaagtccttggagcgcattctctacacatggttagatttctagtcttactgtaccatttaggcaagggggtttgtgactgcaaataaatttctaatggcactatgttttaagtgtttgggccaaggttttaggcaccatgtgttggtgctgcactgtgctagtgcttggcacacactggcaccaatgggtcttgcggtgttccaagcattgttgtgcagctgcaccacatgccactctcactggcatgctatgagctgagcagcacagacacgcaggggtggcaaatcatggtttgaaccttacttttggataccctttgtaatatatttctattgccccccgtgtatttgttacatgatggacaaatccagtgttcgattgaactgtttggataactaagaaaggaaacatctatacttaaatataaataatatttgggtatgttctatttttgctctgaaaattcttatgcttaaacatgttaatatggtcagaaggtgaaacatgacttgttttcagaaagatgtaagctgtcattatgaatgatgcagcctgatttttctttttcctcagggctattcgtcatccagcaagcggatatgtgcagggtataaatgatcttgtcacaccatttctgatagtgttcttgtcagaacatctagatggtggcatggagagttggtcgatttccgaactttctcctcagaaaatctctgaggttgaagctgactgctattggtgtctttcaaaactgcttgatggtatgcaagatcattatacatttgctcaaccaggaattcagcgccttgttttcaaactgaaagagctagtacggcgaatagatggtaccttcatcttcatttgaagtctttttactccttttgtcttgtgtttgccattattttcttgccatatgtctatcgcacttaatcatcttgtgtctgtgtatatcccttgctgcatctgtctcaattccatcatagatgaaagtacaaagatcagtcctgtgcttttactttgggggttatcatttcataatcaaaattttctaatttatatgatctcacaaggaattaatctcactaatttttggctgccttaacatcataagcaatggaattatccttgacaaaaaatattattgtaacatttgattactttcaatccaattatactcaaaaaacattctagaatctagaagagttctctaagctgatgttcaaggggatgtttccctcttctgcaaaccacaatcggttggctgtagttagcttgcttgcattttcattaccaataactgttctatagctttagttttataagttcagaatcctaatggtttaactttcatatcttgttctaatataagaacctgtatcaagacgcatggaggagcaagggctggaatttcttcagtttgcttttcgttggttcaattgtcttctgatacgtgaggttggctttctgtttcatattattgtttaagataatgtttttgtaataataagtagctttttttttttttgggactttgtagatccctttccatctggttacacgtctatgggatacttatcttgctgaaggagatgcattgccagagtttcttgtgtacatatctgctagttttctgttaacagtaagtatgtgtttcctcacttgagagcttcaagtctcatggaccaacattagtaaattttgaagatacaaatttgatgcatcgataagtagctatgtttgcattccattttcctatttttgaaccagccagctggtacaactaaaatgaaacagaaatcagattacagatttaagtgacacaccatgcctgcaatacgcctttttctttgattcctacattgtttttcctaccaccatgcttgtaattttgattgtctactgaactggctaagcagtaaccctctggatatacactacaggactttatatgctactgcttccaaatgagattcaacagccaacgattttctttcagtaggtttcgcaaatcatctggcaattaacaatacattgagcatccatctctaccaggattttcctctttgaatactgcatagctgtcatttaaccatctctgacagttgtcaactctgcactatgagtttccttatagcccacaaactataaaatgtggaatccaatctcatcccttaaaatctccatcctgattttgtcatctagagtataattagatgcatttatgtttgattttaaccaacctgtcggtatctttatcattttggatgcttccttcacttggacacaacatatgtagcattaggaaaggttttaaatcccgtaggacggggatgtcctgattttttcatggaatgggatgcgccgtcgtctcgcctcatcccgatacttaggataggggatgtcccaagacatctcaatcgggacaccgagacactagtgggacagccatgtcccagcacatgggatggtaccttgtcccggtgtcccgtggaacatcttgctgagatctgaattattgacaataggtgatccctatgtgacataatccttgcagctagggttgttgctcttctaccatgctttcagtgaccgtttccagatctcccatggccgattttatactgtatctttcagccatgccactgacatcctcctcctcctccacctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctctctctctctctctctctctctctctatatatatatatatatatatataatgtatttaattatagcataaaataaaataatagcaggcaaaaacatgtaaacatcgtcaaaaacatattctgcataagaattgcctaacaaccacatctagccatttttggaccagttcgcatttggattgaaaatctagcgataaaaatccaactgatatttcaaatatgtttttgaatctaaacttatccaaacttgcagtcccagggatggctaacgtcctaagtcaacaaagctgcaatgaatgaatgaataagcacagataaataaataaagtgccacaatttttgaaacaaataaacaaaatcggacctcaattacactaattttctatttctttttaaaattatcatgggtgtcggaaaaattgcagaaaaaagaaagaaaggtatacccgtggtgctggtaagcttcaaaggtaacaattcataaaaacactgaaaattaaatcccaagtagaccgttagcatctactggatatcttagtaaacatcccagcaaggtggcgataattcaatatgtaaacgcatccctacaggatgtttccggccaaaaggcagttcgtctccatgtccctctgagacacacctgagccaacgcgaacaaaacttcccaaagttccatcaacgaaaaaatcatttgtcatcttatagcgcacctctacgtacatttgctgctttcctgtttaaatcattaggacaactcatacacaagaagattgaagagagaaaaaaatttgaaaattatagtgcagtcacatcatcaaactccatgaccagtacgcgcaaatcttcctttccttggcatgattcggttgcatggaatcccaagttacatagagctatgatcatctataagacatcttccagaaaatagcactacaagttacttgctttaagttctagtaacatgaaacacccataggaaggcaatcccttctggagtgggttgtccctaaatttttgaatttgccgccattgttccaaaagtttagccttctaaccatgtcaaagttcccacgatcaaaaatttgcttgggagttcacctgggcatggtgcgagatatgtgatcttcttcctgtcacagattcaaagttagaaaatgctgactaaagggtcattacatgccaccatatcaagcagtcgataatacctttggatatctatgtctgtgacatagacaaaccctgcgacattgctgcaataagttaaaaggaaaagttagacgatattagctgaagtaaagctcatgaaaaacgaaagaaaataacactaccatgttgccaccaacacagacaaaaattgcacacctccccccaggaacccattagttaattttaaaaatttagcagttacaggagagttaattgcaaggtagctcaaggcatgaaaaaccagctctgaaccagcaaatcgtgactcttggatttgccatgcagcccattctcactagacttttctagcatcgagatagatggcattttcttgaattatcaacccaaaattttacttacgcccacagagaaaccagtagagatctagaggaagagtagactttccgttttctggcatattttttttccaaccaataccaaggattatatcagtataattgagaagaagtggatttttaatttatgctgctaaaatttatgaccatttgaaagttcacatggttaactttttgcatctaaaagtttggtatctaggttccttatttccaaccgtataacccagatgcaccaagatcctttaggtccccagatccaataaggcctggcaaaagccatgcaaaatgagaaggcacggtgacagataattgctgataggaatcagctaaccaaaaatatttacctggagatgatttgatcaggttcctttgcatatgaaacagccagaactagatggagtaagtcacggcttatattaacagcaaccagccgggtagggtctgccacaggctctgcacctataggcagtgctgatcggggtgcctgtggaccaccaccaatacggtagacagaaatatcactgaaattcacaatatttgaatgtggagacaaatcgtttgcaagcccgtaaaagtactcctgcaaagaaacccatttagagtgctgaaacattataaagcttccaggaataactaaaattgataagtacacaagatgagatcattataatgttcctcactaatcaccaacacaaaaagaaagttcatcaccccagttacaatatagacacctccaaaacattaagtgtaacttgaactacctaaactagcatcaaaactaagaacaacctgttttccttccaatgcaagctttctggaccaacataaagtaatgactccaagatggaatgaaacaacattatttataagatttatgtcatcaacatttgtcaactttttgaattaaggtaccaagttcagatcattttttgtttggctcccgacaattaataattaatgaatgggtaccagactctttgtcgaggcaacacctggcaaggtaggggcacaacaaaaagacctgcaacgccgttaggcaggtcagcagacctgtttccataattatacagtttaactcactcttatggagatgaaccttccaaggttcctccatacttggataatatggacaaaaaagggataaagacaacgtctaatgtagggagtttatctatctttaagaaacatatcaaaaagaaattgttaaagaaaccaagtggactgggaaataaaccaaaaattaagattagccaaaatccagtgcgttgacaagccatcattacagcatgacatagatgtgttaggcaaaagacatcttagtttatctcacatcacaatttaaaaataaattaaaagaaaaccagatttacaaaagaaatcaggaataacatgagcagggtaggaatcgtctgaaaaggttgataaaataacatattatgattagtaattcattttttttttaaaaaaatagttgaagaatccaacagcattcactaaggtaataattcataaacaagttaaatcataatcttatttttcaaagatagtgcaccattacaacaagaattttgatacttgaaccctatgtttttctcaccaagaaaaggaaccctgatagcatgtaaacaactacctagcttacgatgtaagaaaatctaaatgcataccttgtttcccttacctgccaaaacgtgtcaagaatacaatatatcttaatatgtaaaagccagcctgcttataaaaaatgtaaggtgtgattggttctatttccatgaatacaagcatatcaacccatctatcatgttagccaagcatactgatgtagataacatgcaggagaggcaaacaagcatatatttcatatagttttcagagtacataaaaaagaatataaagaaataccaaggtaaattattacaaaggtgatgtctctcaacttaccctgattctaaagcttcttgccttctggcggaccttagtattcctcaggacaacaccacctgacttatgtagtttcacaacatcaacattaggcttgctctttagtacctctttcagcatgctgcaaagtttctcctggacaagatgcaccaagaaaatgaacaaaaggaatctgaagaaggtccttagtggataatgcactctaaatcagtcagccaaaattttctgaaattcaaaatattaaagcatttcaaatgctgggatacgggtaggttaccctactactctaccaaacagtgctacttttgggggagtaaagacagcctggttgacaccatttttaaccctcgattcctggctaatttcttctctctcttctcatttcccactttttcagttaacctcaccatttctcaaccagacagcaactttttcttaacccagggatatgaaaatcttgagatttgctgagggttgagcatatctatcctggggttttcaggttttctatcccacaaccaaacacagcctaaagagtgcaactaatgcatgtgtaaattttctaaataattcagaatgcgggagtttcctaggccagcatgtgcacatctgtagctggtgcatttcacgcattcacatgatgtctgccagaaatacttttagttagttttatgctccaacctgaactcttactagaacagagacaagtttaacagacaaacaaacaaataggttatattaagataaagatttaataaatcacaaacactgtaatcagaagatggaattcttgtgcgcatatatcatatagttctgttatttagctcaaccattaagcaaaagtcagaatcagaacacattgatgaatcaaaaagcttactcaaaaccaaaagtggcagagggaaccatgccctttaaatcagaagttattcatgcatacaaaagcttctctactacaatgtcaagtttattttcatacaaagaaaattacctgtcccaagaccagaaccacattagcattgaaggtttcaattgcatgtagaagcaactgcagatcaaaactaaacagatgaatgaatatgttgcagcttaatgtataggaaaatattatcataccagtgagagaaatcatgatacgaactaacaaaagaatacctcatatccaagaccttctacccatcccatggtgttaatcaccatgcctgcagctctagattcagcatttccagaaaactgtctttccagagttcgtgctagctccttcacaagcactttgtacaactcggcattcacactgttgagcaacatattcacaaatgctataattatagaagtgcaggcaaataggctagtattaggacacaaagtggcatcaatctaaaagacctatgtatcataaaatattgattaataagctggtaataaggcaagagaacctactttggagtggtgtgcccataaaaatacacaataggcatttccagaggaattccttccactgcatctataggcatctcaatgggcgtagcagcgatacatccaggaattgttatagacccttgaccaatatccaaatccacaaatgtaggtttccaaccctgtttacaaccccagcttagaagcatcctgcacaagctactctttccagaatccataggtccaacaacaatcactcgaggaccctgaaataatgagaaagtaaatgcttgaacttcaaatgtaaagttcatcagagaacagcagtaagaaagaaaaatgattaacgactacaaactccacaaagaatgctttcaactcctacaaagttttgaatggcaagataccttatgctacctctcactcaacaagtagcactaaagtaattattatgcacaaacaaatataatcttttaacatgtttcagtaacatctagataaggtagcccatctcaatcaaggactccaactatgataagcatctgaaacaagctattacatcctatatactgcccctaacttgacatcctaatgatatatgtcactagtatgaaccattcaaattgatgaaaaattgacaagcttacttcttcattttccacatatcttttaacaagagatagtatacatctttttccatatacctaataattaaatgaacatttctctttccttgtacacagtctttatattctttcctgctcattactctgttatatttctttactcttcactgcaatatccactctttgccaaaatctcttacaagttgtcaacatttcttaacctgctaaactaatgttaaatcccatatctgtgagacttgttatgacaacaatcgaaccccatagtctacagtctatatgttcatcattctacataaatattctgtatcgttcaaaggtgtatttttccagaagcagccttccccgcaaacaaccacaactgcgaatgtggtcattgcttaactcacagccaacaccatcagttgcaaaactgaaagaaattgagtaaccattgagggttagaagtacataaatagcttaatacctgggaagaatctttgtcgctgccttgggatgttttagcacgaatccttcgtccatcaagaatagcatggacattcacataactcaccataggcgtctaaaaatacatcataacgtaaaattttgacgaataaataaccagacatccaagaaaacagaaatctcttcaaacccatccaaatgccatgagttagtgtacctcatctgcaacgtactcaacttcgctaactccatccagttcgacggtcgcaccgttccatgcgaaaatctgaagcgatttgttgcagtcaacagtagattaacgagagaggtacaagaaaatagggaagaggggaagggaagggaaacggaaggaactcacggcgagcttttggcgaggggggatggagagccaattctccggaggaagctcggtgccgaagatctcggcggtgccggagaggaggcggacgcggagcggagtatcggagccgacctccactctaagctcactctccttcgccaggttgaactgccggctggagcccggagcagtggccgtgccggaggccatgtccgtcctccgactctcttcgaaacctagagcacccgaaaagcgagtctagcgggaaccttttgggctgcggaagaggaaacggtgggaaccccaaattgggagaagcccatcagccacttcctcgggagccccttgttccagagccctggggcgagaggaaagcgtcgataggggcgaattgtcacttgtcaggggtggcaacgggtcggattcggatggaaacaatcgatatctatacccgtctcgttataaaaaatttatatccatatccgattggatcggatgaaatttatttattttatttcgaattggatcgaatcgaaatgaactgagtcagacatcatcaaaatcctcgaacccttaaaaaaataaaatcattcttctttcaagattatgctctcaaaatccttccccacacatctctacttctccacggatctctctttcggatgctctctttcctcacggaactcccaaaaagagaatgaaatgcaaaaaaaaataaaaaataaaaacccttcaatctccattctcattttcctcacatatcttcaaaatttatatgagaaaagatcttatcttctaattttgttcagtctgtcttttgctttcgttgattttttctatgatttatcataattttttctctattttttttataggagtctcaatcaagaagaggtgtgaaacttttttggtttttttttttgggggccatagaagcctcaatctggtgagaagtttggagaggagcggccaactagggaagcttagatattggctatgattttgtgttagatttttatatttaagagtttaaaggtaaggatttttgtgttcattatttatatactagagtttaaatgatatttatatatagtaggtcaggtttacgatagggtatattatcattcgtatccgatctaaattcatttcaattttttttttcaaaatctatattcatcccaaattttaattgaatcggataaaatttgctccgtttggattggattgagtcagatacctatcggattcaacaaaattgccatcactagaattgtagaacagaccgaaggataggagaattttaatgcatttctcgatgttcaaaagactcgaaatcaaaaaaattaattatttatgcaactgcataaagctcatttatctcaactaggctgcaaaagatatgaagtgctagtcggatcgagaccattgatttcattattcaacaaagaagcaaagaaagcagtaagtcaataacgagcacaatctaggagtttagaataggattgatgcctgactcatggaagcatattttccataacaaaagataatgagaaattcttggtccaccattttcaatagaaaaaaactacaccacttcatcaaattggaccacatagtatagttaacaacatataggtatttaatatagctcaatatttttttaaatttttttctgacaaaaatatcctttttctccaagacataggaagtcataataaaccgataaaatatcatataaaaatacagaaagttatatatattatttaggatgtcatagaatgaaaaaatgaggattattattatttccttatgctttataagattttttgtgaatcctatgacatctcggataatgctataacatcctattgcttggtataatattttatatccataatattatttttcaataattgttcataggatgtaaaaaaatgtcatatcattattatgacattctattattttctctaacattattatgacattctgttattttctataatatcttattgattgttatgatgtcatgttattatctatgatattctgacaaaattgagcaaaatagagggaaaagatattttggttaaaaaaaattgaaacaaaacttaagttgtattaaatacttgtctcattattaattacgttacatagcccaatccaatgaaatggtatattttttctccatcgaagatgatggataaaaaatttcttgatggtaacaatcatacaatgcccattaagaatgtagttacgatatctacaacagttatattagctcggctatatcgcacagttggaatgattgtcaccacatgcacaatataagagtcatcacctatcaattattgcacattccattattcccaataatagactccaaccccgttctatatataagagcgattcgaggaccttcaatctccaagcatgtttttctcttcattatctctctaataaccttgcctccctctcaaacctttcattgttttcctaaaatctggataacttaaatattggagggttcccacgaacaaactcaatctcaactttatagtttggattttagcaacaacacatctcaacaaatggcaaggatggtcttggccaaaacacaccatcaacttttcaaggtagaaagggaacaagtgatatgtttaatgatacagaaaataaattcattgatgtcaatataatcgccagcttccttgtatttcttataggttaattggttcaagataggattttatgtagttcatgcaatgtggtttgagaacctttataaatcatttacatccacaaaattacacctgcaaacacacccattgtatgagagaacattcaagtttgtttattatttcattcgatttacaaatatggtgacaagtcggctggtgttgggttcattgaatgattacgttcctactcaactttttgtgtaaacatataataatttttcttcaaaggaaaatatacaataaatatatcataaaatgaggggagtttgccaaataaattctaaatcaagcaaactcattaatggaaatgcccttcacttttcaaagaaatattatctgtataatcatgcctacatttttagcaaataccacaagtaataatattaattatttatatttttttgattatcatttttcattgtcgtaatctcccacctcacacaattcaaaatttaaatgtgttatcagcactctttttaacccaagaaacctttgtcctctattcattatcatactagctacttctttgtatacatgcattgcatgcgccaagttacatttttaatatagaatcacatcgatggtaatgcccagaacatctcatgtcttgcttttatatctactactaatgaggctggaaatgaatcggatatccatactcgtttgtttagtaagtgcatatacagctataggtattaactggatattaaaatttatattcaaatggataaaaacacaaattggaaattgaattaaatgcaaataaattaagtagacgttgtattatagtgattttaacgagtcgtatatttatgagcttatatgatgaaggggaaaaagttcgtagcttttgcattggatgaatcgaataaaacagtgagttggagaagggagtgcctgtcacgccccgaacccaatatccgggtcggatacgtgatggccgtacactccttagagcaagctttaaagaatatgcaaggccaaaataaatcattagaaccttaacatccataacaattgatttcaataataattcataaaatcttgtataggtacaaattaaatttcttcaatcctctgatcaggtactatgacactctatctatccatctgcttatccgtaaatccaagccatagtcaatcataaacgtcctgtaactttgagaaaaaaagaaagatgaagaggtgtgagctttacagtccagtaagaatttccatatcacactgatataataatataatttaaaaataaaaataaacaataaaacataaattcgatgttcaatatccagaataatacaaatatccataaattttctgtattgttaaaatagatgcatcatcatatgttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaattttttttttgaagaactgtaacattttggacttatattaatatactaccattatttatctaatacatttcactcgaaattcataattatctcagactacccttgataggaaaataaataaaggtcaaacattgggcactcttcacaatcatcgatttctttcttctcttgaccttccaacaaattttatatgtagactctcatcttaagaaaacctccatcttctatatcagttcgagtgacaatattaaattttaaaaatatgagatctatgttaggactttctaagtttgaactaataccagaattatcaagctgtaacttgagatgtctaaaattcttgatattatctacaatgaaacaacttactaacaaaaattatccgactatgatcagattaaaatcattctttatttacaactaatgtattccatattatcttcgaaatcaaagaattaatatttctaatcaatttaaaccaccatgcttttgctgcgtactctgattttaatttatcaaattatataagtctattaaagataaaaatatccttatatgttagatcaatccaggatagatccaaccttcaaatttcatataagacttaggcaaaatttaattttctttatctttaccacttttgagtatagcatataaaagttaaatcttgatccacttcctatgtttgaactcattgcataagtttcatcactcttcaaaaatccgacatgtctagaattaattggagttaaccttagatttatcttacaatcatttagatgatttctaaatcaatctttctttttaaaagaattaattctaacttgacaaactagaaaaactcaagccaacatccttaaatagaatcaacttgattatttcttatagagctcccttcattacaatccttaatattaatcaataaatccatacaaaaatcttatcccttgtataagttattcaaaatttaacactagcaagatgtcttagttcaatttaaaaaaataataatccaaactttgacttgaataattaatacacttcaccatcttcaacaatcacaagaaaattaaaaaaaaatctaatccaaagataataatacgaattattaaagatttcatcataacctgtatatcatactctgacaaaataaattttcttctttaatttaacaacaatatcaaaatacttttgatccacttagaaaagtaagtttttttttttaacttgaaattcaatgtaacttgaagatcaaggaatcatattcagaatatgatattttgagtaaccaaagatttcaccaagatgtgtatctcatattctcataataaaatttaaatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttttttttttttttttttggaactatgggctgattctgggcttttgggcttggtccagggcccaaatggaccggggtattacagtgcccttcttcggtagaggaaagttggagcaggaggagcctctgaagttccccaagtggaatgccagcgatgtgcttctccatgtgaagaacaactagctcgagttctctcgtccctcgacccctgcagaatttgcatccaggtttctgacattttcttctctctctaatgttaatatggattggtgtgagttcaaggatttggggttctttgtttttttgaaccttctaatgcatataatgcgtgtcctctaccttcgaaaagcctatattttatcatcaaacttattttgtggccatcttcatacactgcggaagccaagttgtcccaaaaatttggatattaatgattaatgtggaggatttggaaagacaaggatcatagttgacaaatacgaatattagcatgttactgccattcctcttagttaatttgtatggcatttacttgatttttatttttgctggtgattcgtacatggagagtgtgtgcaaaccatgaaaggtttgccctgctttggtgcctcagcgtccaagtaattattcatgatatggatcatatatttggatgaaaagattgatggaagtccattcctccaaaaaatagccaaatggaaccaccatccgagcaggttatcagttagagtggcagtcatgaatgaggtgtttaagtcattgtaaaatttgaggtgctaggcagtttgtaaaaatactatagagtgaagctcatgtcatgaaaattttggttttcaatcgttgtgaccaaggaaatgagagatgtacgtcaactaattaccaagtggaatggtaaaagcttttggagaactgtgatgatttttgttttggtaaaaaggtggtgaatacaactggccttgtccttaatttttagtgcaacaataaatggaaacttgtgaaggttataattccacgagctcaacaatttatcatgagaccaacccaatatggttgttgttgggctggatcttctggcttggggggagattgcatttgttccactgaggatgatccatttttagataatcatggataaatatttaaatactagaattattgcataagtatataccttgggaccaacatttgtgcaagctgcaaaatttatgaggttgtatgagtaaaatcagatagtttttccctccttaaagaggtccccaacagagagagtttaacacccattatgaaggatgatgtgggtctgctgaatgaaggctgatgccatcaaagctgagccagagcgtctttggatggttttgagcaccaggataaccacatattagaactggggatcaccttggtggagatctaatattgggtagatgaatgtcatgaattatgcttatgtttcagagtgaacaggatagtacttggatggttacatctctttccagtaacatgatcatactttgatagttacatctcattcaagtaaaaagaaaccagagtcaagttttgcattcagagccaggacaacaaaaaaatgagttcaatttttgaattgaaaaataagagagcatttgagaattctggaggcatctgccatgtttttcctttccactcgatattgtacatttcctctgaaaaacaaataaatgtgaagaattgcatttactcatcagtctctaggcccggtacgtactccaaactgacgtcaaaaatcacagggctgttcggggctactcgtggccttcctggagctgaattaagacctttagggaatgctaactgttgagattagagcacaagagtatcacagaattagatttagatgccttcgaaggaccaatgtcctatacatcagaattcggagtgatttttcctaagaaaataaagtgctttactagatagcattctgactcaaatttgctaattacaagagtaatatatttgctacaactaaaaaaaagcaattttattttattattttcttcttccttttgcacacaatatctgatccttgattcaaatcattctggtcagaatacttacagagccaggtatgtatagccggcgctttcctccaactttcatgctcaatatcccttcatcgagtcctttgatcacctattatcgccagagagacaattgataacagggtcaatgtcccatcatcaagtccgatgatcactttcttcagacaaatgagacaattaataggaggatcgttcgaaagctaaatacatcacagagaggtggaccatatataaatatatatgaagatgatataagtaatataacagattgcaaggtgacattttccctcaaggaattgttatttacaacttaagtgagctgagaaagacatgtttatggcaggattgttccagttacaaagattcaggcttccttgaatttgggtgcataatttatagttttgtaatatggaacaagcaatgaggtttcacttgaacaaatcaagttcaacaagaggcggagttaatattccttgcccacagcatatatgatagttttgccaatttaattgctatgcggtgccatgatttggagcaatgatatcatcttaaaatagttttagtgacttcttctgatgacccaaaagcccattattaatcagaaaaacaagcattagttaataaggatgaaaaagaagagaactgatgtaaatattatctgcaaaagaaatttcaggcaatcagcttggaaagcccaacatatcaacaaacagggatttcacagtatataggcttgaaataacatcattagaagaaaaatgatacactaaaagttgccaaacatggaggtcaaatttttagaagacatgcaatggtagattacctgaccggaaccgatgcggaaaatatatggttggcctttctccagggagctggaagacaatataatatacatttagaaatggattaaatgacagcataaacagacaacatattaactgtttatgcattttctcagaaaaaatataactacttcagcatttctaagatgggagttgtatcatccataccttatctttttatttgaggaaagttcattcataccttatcaaattagtcagcagaatatatggatttagttgagttaaatacagcatgaatcaatttttaagaaggtgtttacaagacaaaatgtgcaggtgcctctctttcaaaaatgataaaaaaacacaactaatatgtcattgcattcctaaaccactatcaagcttacaggttcaggcttatcacctatcgaatatttgtccagactgtaccatggcaacatagtttgcagcaacctataagataaagacgggattgggaatggttagaatttgcgaaaaaatctaaaggaaaactctgaaaacaggacaagatacttgcaaaaaattaggaaaacactgccagccagtttttttggtgatttattgttcatttctcacatgtgctctgcatgcctacatggtttccaatttcctgtgttaataacattcttgtggagattgtttcacatatcagttcttaatccatttccaaaagattaagtataaatatctagaaataaggcagatttttacaaagaattttaacagagccacaattagttctcatttcacaagtgagcattcagatgcaaaaatttgcaaaaagaaccatgtctcaattgtttgaggcataaaaagaactacctgaaaaccaacaggtggacttggacctttgccaatttcaatatccttgtactgcaagccagattctgtagttaccataggtacctgaatggagaaaagaaaagaatgtatgatcatcacctatatttaaatgttctgaagaaaaaagtctatgcgatatatttgaggtttaatgcttaaacttcagaagtgatatctaaatttaagaccaaaacaataatgtaattttaaaatattacatggctattttagaaaaaaaaaaaattcacctacattgccagatcatagaaataaaggatatataagctgaagctaaacactgacatccactgtcatccatagaacatcagttattatttcctccaaatgatttcactaaacaagagactaataagccatatcaatcctgtgggtacagtttggggatgcaatacagttataatcaaacaaagggaaactagcatagccatctcgcctataccaagtatttgagtcggtgttgcgggtcttgatttgcaaagcatgtatatttaacgccaccaacaatgcagtttcaagcttttccatatctctcttgtagatctctacccttgctagtccttcagtgcaaatgaaagttcccctcttactagagcctccttagaattcattttacattcccatatatcatcctaatcgatcctccatcactttctattaactcgacctactcctctaatatacttatggtttatcgtatcaattctccatcctaatcgattctccagcttttccattttcactggatgaaaacagtggaggattatgttaggctgacagccagttgcgaaaaacaagtgaaaactgtaaaatggaatgaaagaaactcgagcaagcaaaaaattgtatgtattataactacatgcattctatttatgaaatgatgaccatgcaaagcatgcaaaaatattgcaacttatgtcaatcaaaaaagtcctcgttcatttcaagtcataaaagaaattttattttttaaaaaaatctataactgatttgacaatgaatggcgactctaagagccaatagcagaactatttgacaatgaatggcaactttaagagccaataccttctgctcaagtagatatttaacataatgcccttttgctctattgtcaccataaatcagggacaatttaaaagtcaaacatgaccaatctcactagaggcctcttatgatggactttcactgtagatagttgcctgagaacatattaaagatctcaaatttttgaggaaaattaagggtctcagtatatcctaaataagtaagcaaatgcccaaaggaacaagctttaactgcagatggaaagtaatagcaggttcagactaccacaaaatagaagtaaattcataaaccagaaatccttattgcacctacatgaggttaaaaatattacaatatagagaattttgtgaaatgcaattacttatcaagaaatatgtgtaaaaaggtgtgtgcaaggatatatatcaattgtggtaatgatagatgcccagggaaatgcaatctcaccatacattttcaagctccttttcacaaacatcatcacataatcttggcttttgctctggaggcaaggcagctccattggctttggcaatagctaaaccgaaggcagacatcaccaaaaccaatccaaatgcactcctccgactcgttagtttggcatcctctccataatttctcatcttgacagctttatatccaggctctgaagccgagcagcagacttcaaaacttaggaacttgtgtgtggatatcatataatgactgcaccatggtctcttgggaaagcttggagctatgcacacatacagcttaattagagaagaaagttgcccaaggataaaacaatgacacacgaatcttttcaagaaaaacaaacaaaacactcatctaagtagtgacgaatgaaacattatgctactttaagaattactgcgtggattaatagtgcagaaatctttaaatttctccttcccttttttattctcctctctaggcatttttttcagaagtgattaagaattatttcaagataatgatgttcgtatttaataaaaacataagcatttttattctcatctctattttttttccccacaaaatctctgccttcatctgcaagaaaaaagtaacctatgataattaacgtgttaatgcataatggttatggtagcaaacagaaaacaaggtggaataaaaagaaacaaaagaaaccatgaccaacaagtcattattttgcaaaacaaaatactaagaaatcccattattttttaacaaaaaaacagctgcgcttattaaaaaaaaaaaacagaatttttaagaaactaaaatatatttttcaatgaaaaagagttaaaagaaacacttaacatagtggccctccgtaaaattaatgtaacattataagatgcatttcaaatttctgacacaatcttctcaaggatgaacatctgcaatatacaataagtccgacttcctaaaatcaggaagagaatggatttgatttaacaaacccaccaaacagagtgaattgattcttcttcgttccagaaaattatgttcctagagaactttttcttcaatgctaacatgctcccatatgtacgagataccggtaggggaaaattaccggaattagagtgactcgacggcaactgtataacgctataaaataagaaaatataacaaagataaacaaatgctccacatccacagaaagagagagagagagagagagagagataaggggtcacctgaggggagaagaagggccgaggaagaagccatggctgcgatggacaaggactggatagagcagcgttcatctatccgtgaagagtcgacggtagggaggacgcggtctgagccactcgttacaagagagaacaaatgagaaccttttggcacccacctgcgagcgaagtttaccacgtgccgtagacacagccaatagaaaaaaattcatatcatcattttaaactaaaaaaaaatcctgcaaccatcacaatatactgcagcttaatcatctatatctatctaaaaatttctctagctgcagcataattgatagaatcagttcgccaattcagagtttctagctgaaaaaaccaaagtccgagcaccgatcgaggtgcttgtggtgttgaagaactagaatgctgtcagacagtaacccgtaattgaaaaattaaatatttatgatgttttattgtcttttggttttatggagctagtaagagaatggtaaatgctagggagactataaaatcaaccagcaccttgagatatcacctcaaaaaacactataaaactagttgccataaaatatgattacatgcatgcttttgattgtaggattgcatttggtaaccgacaatctattcagataattgacaatttaaaatagacttatcaaattactatgtttaatatatttttggatgacaatccagattacctctcagaaaataatttaaatttttttgaagagaaatagttatctaaattatcatttatttgataatattataaaaaaaatttaagcaaaattattcttcaaaaaaaaatcaaacaaaatctattcctccatcctcctcctccgacgactctcaccctccccttattatacataataatatgatataatatattataatataatatagtattattaaattattattatatttttatagtaattatactatattacaataatatagtatatgataatatattataatatatattatataaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctccactcttcatctctttttttctcactttgtcttgataattaactcttcatcttattactttctattttatatctaacttattgcaatttaaaagctccaattcaaagctcagtaaaatctaaaccatgaactcaagctcaagaacttgtttataaatgcgaaactatatcttaaaaattatagcatattatgagctgaaatgaggtccaagtatatcagaactttcctatttaatttaattccaaactcttagactggccataatttagtttatctggtctcaccaagttctaacttctcgaaggatttatcttgaaattttaagttgacatgaaacaggtattaacctttttttttttgaatgctgacatgaataactgaattgattacaaatttaaaattcaaactctaaacgaattagataattcaaatcatttgcattttaatagaattatgtttatttttatagaaattctttttttgttctgacgttacgtggaccacactaaaggcactacgttcaaaacagattgtcgtgctcctggctagtaatttttggacggatgctcccaactggactgaggtgtgagggcccgaatttattggaattttttagttaatttatgaatcggaaaaatcggagatgattcgaaagcgaatcttcccatcttttctagttaattagatttcagtttttgccctcttcatcttcaaatattctacactttgtgtacatgtaattattctgtttgggagccctccggttctcctccgaactgcaagcacaccacttcgcccgcctcgatcttatccgtttccttccgatcttttctgcgaaaccgattcttctcacctccttctctatagtagagcggagctctcacttcgaagatccatcaggtggcagcgatggagatggccttgcagccacggaggccttccttttgtcggatgatgctttttggtgggacacgattcgaaatccggccggctacacaagtgagtctctctctctctctcgcggatgctctctttttgtcctttttgccctcgcctttttggcttgcggcttcgtttgtggctttcgtatgggaggagagcttgcagcctttcgggaatttaaatgtgttttaactgctgtgaactttctgaaacttttctgccttgcaaactcatggcaagtttttgattttttgatttttttccccttcctccggtttttgttgttgttgttttcggggatccgtgtcatttagtatagaattcgaatagattttgtgagtcttctaggttgtaacattggttgtttgcttattaaatccgtccagaagtgtaacacgtagaatcacaaactggtagaatggatgagctatcttgggtttttgtgctgtataattttattgaatgactagtactgtagactttattgactggaatttttgttaattgtcaacttcctttttcttctttttcctatttgcctgcagtcttttttatggtgcaaagaattcacaagaatcaggattatgcctccacttgcagcaagctctggttagtatgatgatgcgattttggatctcaaggatttcattctatatgtttcatgttctgtttctttgaattgcattctacagagtattcaaggaggcgcccaagaagaagctcgattccccggatgaaagattctcatcctagaggatttgcacctagaccccaagttggaacaggcatccagaagaaagatcaatgtgatgttggggaaaaagaagaatctgaaagcgctagctcgagtaaatattcactttcaagcagtggaatcaatgaaagaaaggttgctggaggaggagtgaaaaggagagtggacgtacttgaggaagcggaggaaaagagttatggggaagatgataaagataaaaaaacctttacaggaatgtcttctgcagctgctgacgattatgaaactgatgggcagagagctgaggatgaggaagatcaagtaggcttaagaaaacagcatctagaagttattgacatgatagccaccgcaggaaaacagccaactgcatctcttagtgaaaggaaggaagaagttgtggttgggagagatgtggaattaagtaagaatgaggaattggggaaaattaatgagcatgcggcaatcacagaatcagacatggaagaatcattaatgaaacagaaggcagatattgatgcacaaacacacaaacagatgctagagcatcttgctgatgaaaacttctcaagtgggaacaaggtatttgttgttccagaagcggtgaagtctgatgaagttattgaaatattctttaatcgaagcttatcagctttggtgaatgaacctgatgttttgatcaagggagcattcaatggttggaggtggaaattttttactgaaaagatgcacaaaactgaacttcaaggggattggtggtcttgccaactttctgtacctaaggaggcatacaaaatagattttgtgtttttcaatggcggtaacatctatgagaataacgattcaaaagatttttctttacctgtagaaggtgagatggatgaattagcatttgaagatatcttgcttaaagagaaacaatgggaacttgaaaaacgcgctgcagaagaagctgaaagggaaagaaaagctgaagagcagtgccaaagggaggcagagaaggctgcaagtgaagctgacagagcacaggcaaaggtggaggtagagaaaaagcgggaagctcttcatcgagtaatgaaattggcaaagtctgttgatgatgtctggtacattgagcctaatgtattcaaaggcggggacatggtcagattatattataatcgaagctctcgcccacttgctcatgctacagaaatctggattcatggtggtcataataattggattcatgggctgtctattgttgaaaggcttcttcgatctgaggaaaaagatggtgattggtggtatgcagaaggcacgtataattggtctatgcttcacatctatgttatactataattagttaatgttgtatacagcatttgacagatgccttcacatgcaattccataacattaattgcgaaagatgtcatcaactgatgctatgctattggaagtgagtatcaaaatgtctataacttaagaaaactagaacttttatctgaggaattatgcatgacttctgaaaatgacttggtcataaaatcaaaagagctactgctagctagtttctcatgaatatgaaatttaatgcgaatattgaaggttgagattgggttaaagggaaacctaatgcataagtggtttcctttagtatctctaactcgaaaagtaatttcatttgcatacttacagtgtataaacatattttgaacaataagtataattttgactaatttatgaattattgtattataaattatcatggacttttatggttattgatgcatgtattgttgcctgtagtttttgcacaactatgcatttacatcaacaacatgagtcctcaaaattcttggtaaattataataagcggaagtatatctatgttcactaatttacaacttattttaggtgttgtacacatactggtggtaatatggttagcttgtaaactggtaatattgctcccaatatcacctcatttactatatttacaccagagtatcgtgatggacttggaccatcattattaggggaacaactaggtttttcaccaggtgaggggaatggaatcttaattgagggaagtatgggaattgtaattttatgtgctacattttacgttaaaatactaatgtaccaattaattattatcaattgatgtattgcaaataaatttgtttagttacaaagatatataagaataacttatcattcatgtggaacttgtaagcattaaaagaaacttcaatctttaattctttataacctgataagtttgtgatggatatcaacccatcggtgaccaaacaattatgatttttcatatttctgtatgatcactatgttatcattacatgcttctgtatggtcataatatgcatcctagaagctgtagcaaagaaggtaaactatttcttcgagatgacaaataaataactatgtgcataaagaatctatgagatttcaaggaatctgtaatgaacaaagaaaagggggggaaagaacactgatggagaggactttacctcacacatgtaagtggatccccttcttttctttttctttttttttttgttctttttttcttttgatgattccaaacaaaagattcatgaagaaagataaatgtctaccctgccccaacatctctctcttttatccatgaataagaggtagtgtaacttgtgagttcttcttctttgattggatttcagaataaaatttttctttctctaaaatttacgcatttaatattatttcttatttactatgaggtcatggagtattggtggcaacaataggagataacaccttcttatatgtaataaggctttgagaagtttgccatcctttttgttgggtccatattaaagtgtattaatgggcttaaagggaagtggctcatggaaactttggcgggtcatgccctatgccccccttcctcacttccaacctttactgccttcaatgtaggtaccagaagacatattaataatgcatgcatgtgatttatcatcaggctaatagcatatacttttatattgtagctcaaagtttgtgcattttaaccaatgaatgtctgaaatgggatggcaaggtacatgcttctttatgctatattgcttacccttgtgatatcttgggagtgtataactggatcaactgttgcgatctgtctacaagcatttctacgaatctatttaattaacattattttacagcatttgaagtcaaaacttaataaattctacttttagcgctactagatcaatagtttgaaagcaaatggtttctctctttatctctccacatgcttggcataaaaccttcttttcattttgcttcttgactacaatcctgatattatcttatatgtagcaatttctgatttagtccttttatgcagttgtggtacctgaccatgcacttgttcttgattgggtttttgccaatggaccaccacaaaaggcaaacatgtatgataataacaattctcgggattttcatgctacagtcccgaattgtattcttggagatctgttctggattgaagaagaacatagaatctacagaaagcttcaggaagaaagaaaattaaaagaggaggctgttcggaaaaaggtcaatcttaaccattgttatagtctgcatttgatcatatttcttctgaaaggatattaccttattatttcttccatttcctttttcaataagctaaattgtaaacataacagaagaaaattttttttgagtaatattgttattttggttctcataggctgagaaaactgcacgcctgaaagctgaaacaaaggaaagaacaatgaaaatgtttttgttgtcccaaaaacatatagtttatactgagccacttgatataagagctggaagcatggtcacagtcttttacaatccctccaacacggttttaagtgggaagcctgaagtttggtttagatgctcatttaaccgttggactcaccatagaggccccttacctccacagaaaatggtgcatgcagataatgcttcacatctcaaagtgactggtgagaatgacatctagttacaaactcttttatatcacttattcatttatgctatatttctatatttgccatgtttctacattccttatatctaggtcccttatgactgccattttccatgcaacattggttgtgttcatgcaatcaatatagttagtactaaggataatgtcgtgtttgataatgttttataatttgtatctgttggggcgaagtcagcatttagtcttgtatcctttggagaaaaggccagttaacttaagagacatttgtgtgttttcttttctttttcctttttttcttggaataggacaatttacatttgtacctgctattataacacagacttgttggcttgcatatctaattcttcacgtctcctcttggcatttgtataatgatacttctaactttaacaaccacaccactcttaggatcaattaatgtgaaatagatagagttccttctaagactaatgtccataacttaccaccattaaaaaattcaaattttaaactaacaaagtttgaattattacaaggaaaaatttggaagcttgagtatcaccaaacttaactgacaaacttgtctccaggcatacaagtttagttgtgtgaaagattccagtggctcattccaaattcatattaacagtttagcctatatctgggattgaattcaataatttatcatgggagcgcatgatttttcaggttcatcctttaacaagattatcgtacattcctcctacattttctgtaccgattctgatttgtttggtgatttttgatcttcactaaagccaattgattttgaagccctcatgacatggagtgaaaacttctattctatttaaagtaacttcggaaaatccaaacatagattagagcccttagtctgtgatttgagcaaacagttttataacttgcaaaaattttgcatatcttcatctttctttctttgtttttatttttcattaattgtttgagaacaagatattgattaaacactcagccaagcagccggaatatgttaaaaatttttatatcgaaaactacaattctaatgtgcatgtctcgtatgatatgctaatgtagttttgattcatttttgtcattaggttataatgaaatacagctttcgactaaattttccttttacatgtttatttgcatgtagattatgaaaaaaaattactatatatatacattaatacatatgtacttacatacatacatacatgtacatacaagttatgccatcttggtaccggaccccaaattagtgccaccctattattgtgttgatatgcttggtatggggcatcttcggcgtaccgagtgttggttcgcctcctgtactgtatactggtatagaattggtacggtaggttccataccacatggatcggtatggtgtggtgtaacatgttccatttccaatatcttatgttaaaggaatgaaatgtcattttttctgctgttacagttaaggttccttttgatgcgtatatgatggactttgttttctcggagagggaagatggtggaatttatgacaacaaaaatggaatggactaccatattcctgtttctggaggaatcttaaaggaacctccaatgcacattgtacatattgctgttgaaatggcacctattgcaaaggtatgttttaatgcttatcttctttctaaagcagcatgagctacctggtgtgttttttgcctctccagtagtacactcgtgctctcaatttgcagacagtttgagagaacctgatttgctgatattcgctagtgagtgtgaataacaaaatgtggagttaacgtacaacaccctggatgaaattcatgaatggattttaaaagcaaaataaagttactcagatgaccctcaaaatagtgattggtgaaaaactaaaatctgtttttcgtaaatggcagggttcactagtcttgtgataatataattgcacgactgatgataaggtgtttggtctacttttgcttcagtttccatgcatccaatttaattgtgttaaatattacttcctgctccacaatcttagtacgttgattaaaacttgacaaggtaaaattctttggtactaattgtttccttggaatttgatgatacttgtgccgcaaagaatatgaaatgcttctatcagtccacttaatatatgcaataaatcagctacccttgccatcatctggtctgcatgatgagtgtgccttatttgagttatcaattgccttatctggttttaaaaccttcccctcaaattctgttgaaatcctggtggaactatcttcagggcatagaagcactatataacagaacttctattatcaattggatcgattttgttaattttactcaatagtagtttatttaaagcttcctttcatgaaatttacttttgggctcccctccttccctatccttgagcttaaatttattgccccagtatgggagttgaatctggcccgtgttctacatcaaaagaatatttaaataaatacttgataaacgtgaccataacatcaagccttgtcccgattatttggaatggtctttatgagtcttttcatttgctaaaatttccaatttagggctacctctgattgttttgtcaagctctccgtatctttttcacagcgttcatccttgacatcttaggtcttctcttatccttacattttcaaacaaaggtactatccttattgttgttctctcagatctttgttttacgttgcatagaacaattaaatctacatcactttgtccctgttcattaatttgtgcaactcctatatatcctgtaatatatttatttttcctttaataaccaaggatgtgatacttagctcctgtagcaatgctcctatgctttattacttgaagctagatagtcaaaatgcattatttgataagcgcagggttgataaattttgtgtagtgccttgttgttgtgaatataaagattttaaacaagcttttgtccatacttatttaaattttaattgataatatgtatatttagtttcggatggaaatccttaggtcaaaactaagttctagctacaaagttttatgcttcaactctattatgatattaaaccaatgagtagaaatatttttgcatgtcatgcatttaatgcctatactttgttgcatatctacaagtttcatgtactatgggtgagcaggcaattgcccatccccattgtaattgtacttatttggtttttacccctatgagcggataattgcagtcttgtgtttcattctatactttatccgaaagttccatattgttggagatcgatttcacaaccatgagactactataaaacctctagtgatttattttaggagatcagcaagagtttcattggatttgataatattgggaagcacgtgtggagacatgcaagcatgatgtcttgctctaccttgctcgttgattacatgaattcattgggtgggaataccatgtcatgaggataccatgagaaggaagaagtgtattatgaagtaaataccttcaatgataatgttaatattcatttatctactaccttctataattggttggccgtataacaaatcttgattagtgagaaccaaatgatggcattaaaagcccatcaaggtggggccatggtcctccaaggcaccaaaatttttcattcaaatcttgtgaccctgcatccactattctaggcaagaaaggctgaaccggtaccagacaacgagttggttggcggtcggtgcggtatgatatcaatttggcaccatccgattatggtttgatcggcaccccattttttttgtttctttttttgacttataagatatctaatcaattttttattatttcttgaatgattttaagtttaaatattgtttctttatcttatttgatgtttgtatcatttcgatacatccatgattaagcgtgtgatatggatctcaatctaacataatattatgttagaggaaaacaatcttaaagaactagatattattgaattttaaaatacttaaatcaattaagaaaataaaaaataaataaccaatacatatcgagacttagaatctcatcgagcgtcgatgtcgttcataaatatttggattatttacataatctggtgaaacattagcccatctctttaaccatgcagtactgtaattctctgcgttcatcccataaggtatgcatgctggattgtaagttgtttcagatctctctttgaagctctgactctgagaggtgttttcggattgatagtacggttatggagggatccatccaaatatactggcagcaaaattctatccgtaagatgctccgtgctgtatagggtagtagccgttggaagatgatgccttgaacgcaccatatctatattcatatggatcataaattgcctatggttgtcaataagaggatccagattatgatgaaccagatatgaccatggatccaacttcacgtgcgaggtcatctgcagctacatgatgtcttgaatgaccttgaggggcacgttgtctgtatgaaatcgtattctcacgagctccatcagctcgtatcccgtggttcttatcctgtgtggcatgcgtaaattgagactcatcagtaaattgaaggccatcttgcagttgtatcttataaacagtggtcttctatcctctgcttcctccatgacaatcagatccatgactatcaggagaactaccatcaccactttgtctagtctctgaatctaagtgactggatcaattgactgctccaccctcttcatctgggctgacattgtctttcctttttctttgtctctgcattgagaagttgcttgcccttttgtcatgcctcatgaggaagtctattgtggctgatcagctggaagcttgtgtggaatattactgattgtctattgctcagcatccatcccaacttcgctagttagaaaattgactggtcgtggaggcgatcctagcttatcaagctccggctcctattgctgactcattatctatctgattatcgaatttttctcatcatcaataaaatcattcgcagtcggatccgagtatttcaacttaacttccttttgaatatattttagtctcaacctcagattgtaatgaatatatacaaggtcgttgaggtgtttctgtgtcagatgatttctctgtttgctgtggataaggacgaaggtttaccaattacgctcatagtcactcgaggagattgtctgggagaggatccgaatggtaagtcactttagagtaggcgctgccaatccaaaataacccatcactaaggattggcacccaattttaattgggaggctccataactgtataacataatctcctctaattctagattttctatgcatgatccctttgtaatcttgctttctagatggacttggctgtttgttatttaaacattgattatctgccgttctctccccaaaactaattccaaatcatgattcctcttttgatctgtgccttgcacccaagacttcatctttttatgaaattatacaatttttattgagtcattactatcaaagctgagtgccttttgcctgaaccatatacttttcctgaaaagaacataaaatgatgtgatcttgctccatgcccatgtatttttctttttgcctaagaacaattgcattatgagaagcgattcaataaagcacactaaatttatattgcaagttgtttctttgtcagtatgcattcagttcatcaaaaaaaaagcgttgaattctcaaggggattaaaatatcccatctagatagcggatttctataagtttcttggggggattgtaatgcatgcattattttcttatgttaaacattaaattataatataagttttaaaataaatatcaagcactacatttagttgctttgagatcaatggtattacattagattgttacaaggaaaaaaataacactaaaaacaagaataatggtcattagttttaaatttatgatgtgaacaccaaaactgttatgcatttgaatgtttgttttatacatcaatttcacgttctagcctaaaattttacccctacatggtatgaattttagtgatgattctaatcatttggttgtatgattttcttcttctgttgcaatgcctttcaaggtcatactaatcttttgaataagttgaacttaaattgtaattatgtctatatatcctttaggaaaatagtgtaaatgttggtgtatttttgccctccctaaaggaataaatcttggctttgcctcaggatattgaggcagttaataaagaaaccatgcaacaaagtaaatatgcagataaattctttgatgttataccaggcgattcatcttcatatgcttgaaactttttaaactttggacatgggtgtcacacaagtgagctgttcatgagcaactcatgttgggccaggtgtttttggcttgcttaactaataaatgatctatacatcagctaggtttttgaggttgaatataaacaagctgatcacaagctagaccctgctcacttctattcagcttgacatagctagaaataaaaataataattattattatctaaataaaaaatatttttatacttaagattcatattttaagtgaggaagcacaagaatccataattatattgtaatatgataaatttaaagattagctactagccacttcaaaaaaaagaattagttactggaattagcagttatattcttgaatcttaatccaattactattattcatcaggcttctaatattggcccttttcctttttcaatccaggaccgggccataggtccatatttctgttttctgcatcctctttccaattttgctccaaccacttattttatcttctccacttccgatattaggtttctggctcttttcactgccttcttcttcctttgccattgatgacggtggtgatgatatgaggctgatgatggttattacaataaatatttgatcttctctctctctctcacacacacacacacgcgcgcgcgcactttctttttattcatttggcttccatggacccccgtcactccctcttctatccccttctgtcgcaaattcactcactgttgttctttttcattgatttctttttcccatctgaagaagatatacggtttcaagctacatggaccaaactcgagctggctcaaaattaaacaaactgaattggagatgatcctttcgagcatgacttaaacttgaggtagcctgattaagttctgagtcaagctcaagcttgagctaagcctagcttgctgaacttcagctcatttacacccctaactttgggttggttgcacttaattaatcaaaatatggggtttttaaggagaggatagtgaaagaaagtcccaggtcctcaacaagtagtagaattatgacatcctaggaccatacctaaaatgggctagcttgaagattattaattggggtcctttgccttgctcaagtgcccgagacctcctctatgcacagatgatgtgggtctaaatgcccttgcgggcctctcatactcccctcattcaagccctaccatccacattaaggaaggatccggtcataaaaaacattactggtttggttgtcagcccaataaaagtatgcatgctgatcctgtagctgcatgggctgtgtgttgagttggttctgataccatttgtaaccacttgggacctcattcaaaaagggcaagccagaatgttattaattggggtccttggcatttcttatattctaagaactccccacgcgaccaatgtgggactaaatgcacacacgcacatgcatgggttccctcatgaatgattggaaaggttgtgtcgataagccatatcgctgttctcagtttcaataccgaagtatgagatgatagtttgcttggcctcaaaaagtgatcaaggactcaacataatagacatatgctagaccataagtaattcgtgaagacaatcttgatcctttacttcaagtgttaattagagatacagtttgtgaaaagcatcatccttgatatttgataatgcattctacatagaagaagaatggtaaaacctgtatcaaaggaaaacaggcatgctgtgatcatacccataataaataatgcttgcttttgttataatctgactaaatttctcaaaccagtccctaatcgcatgtaatgaaaataacaagaatgctgggaggaaattgaaagatcagggttagctaaaataagctgaattcttaaatcaccattaatgaattctattcttcatatgatctgacagtggccatccatggctgcaaattggcaataagagcatgaatttggtcatcttggcacctgcaaaaaatgctttatgcctctatgtcattctgttgggtaaagcatcgggctaagattcccattatgctgctctatcaaaccttccttctaactctaaggtttagcatgacagacttagctgcacaggtagggatttcctaggtggaaggggaacaagatcttagatctaggcatgttcaatcttatgaccaatcaaggaacctatgtttatccatatttttaggtgcactgaagttctgttatcatcgtcatctgagttgcatggtatgtgaagttttagaatctcagaaccatactgttaacattttaaaaaattttctttcagtttctacttgatcttcttgattttaattgcctgatgcattacagggatctattacattattactttcactacattgattttgtaatgcaaataatattttctattggaaacttaaaacttaaaagcatactgtttaattagttatctgtgatagatgtaagccaggcatataatattattttgatgagtaactgacctttttattgtttaccgtgccatttctaacttttgcaggtgggaggtcttggtgatgtcgttacaagtctttctcgggctgttcaagatttaggacataatgttgatattattcttccaaagtatgactgcatgaatctaagcaatgtaagactcttttgtactactctttaatctggcctattttttcatagttttttctttttaatcacataatgcttgtccatgaggttcaaaccactgcccagaagtacttacatttatgaaatgcttggctttttaagcccatgcttctgttcattgtgttggttgaaactgaactgagcacatgcctctattctgtcaattgttatcacaagtgtatcttgtggtgttcaagtttttgcccataataccaatatcatttttcttttcatgaattaagttgcactcctatttccttaataactgcttctgggcacatgtgacccaaagtacacaaacagttcttacattgtattaatttgtagtagttatatttataattgatattgtatactgtctttttggcatgtagtaaaaatgaatttgggagaaaaaaaagaaaaaaagagatgaatgtatgctcttgtttccttccacttttgtttttccttgggaatattactttgatctaataatgactaccatgttaaatgagttttttgtaaactttgcaaactgcatatgtcattacgttttctggatgctagttggcaaactgtttattttttctgacaatgagctaaatgcaaacttaacttgtataattttgtggtctgtggtgctcactttttgacatttctctcaactcaaggccaacacctcttaaatgaaaagggtgtttaaatgcctatgattgaactctaatgctacggattcacatgcaaggcatgagaatgtaggtctagtaagatcctagggttcagaacaaacaataagctttctgtccagaaagtttgcaggtaaaccaacaccagggattgaaggataaaccaaaagatggttaggtagaatatttgatgtttttagggatgagctaatataattaatgggttaagatggggtttgtgtcatttagaaaggatcttttatatttttaagtagattaatgtatagtttttttagaaatttgaacagagaaaaaggtttgtagtggaaacagaggttagggtatgttcttttgagttttgactagtttactagtatctctagaagaggattggaatctgcttatcatcagatttgcagcgatgaagatggtggaagtggaaaaactgatggaaaaaagggagactgtaggaaaagaagaaagattggttgatcctggcatctctctacgtaatttgaggatcacttaagaactagcatatgtgaaatccatgtgactactaaagaaagttttgtatagtaaattagctctatcatgtttggaccttgtagttcttccagtttcattgtgtaattgacagagaagagaaatgaaatgaagctggtcctcatgggagtagctgcactttttatgtctctcaaaatgagaaatgagaagttcagtttaatcccaaaactttgctgatgtcatggcaagtgacaaacaaattgtctcttacaaaaaaaaactttcaaaccaaaaatctggattcatgccgcattgtagatttgcagctggctgaagtagttcacttccactttgtagaactcacccttaagtttgagaatgcacaccttatctttgtgacaaatccaagctgccctctggctgtgaggatgactcatagactagtcaatggcaccattcgtatcagcttatttttccccatctcttttctactactgtttgtttgcccattagttgtttcatatcttgggggcttgatcaaattttgagctctctttttgtcattccattcttgttttgtatgtctttttgatagattttgatagtcatgtcgagttgccagacttgatgcaaaattgaaaatgcaatgacgatgtggtttgatcagaattgatgatttgacatcttatggctgtgcgaagtgggggcaatgctaatgggacatatctgttgattttgtgtagaatgttaatgaaagttttcggtagaatataatgttgacaagattctgaaatacccttgttattggtgagttgccaataacctatagtggatggtgaggtgctgtctttttttgattgaagctggtaagaccctgatatttattgaatagtttttaatgttgttgctttttgatttatagcttatgtgttcattaaaaatgtgaactcagatcatattttgacaatagacattggaaaacatctgaattatgattgccttatggtcaatcaggggaatcaaacttgcgatggtctagcattttttattgccatgttctttccatggtatctcaagagcttgatcatgaaagaagtttggctttgatcatggattgctgtaccacctcatatcatatagtacgggacgtactatatcatatcgggtgggaaccaatatgaaactaaagttcggttcggtacaggccccgtaccatcttgtaccgctttttgtgctgaggcataccaagataaaaagtgataaaatggttggaggtctatttttgtatgggtgcgtaaaatactgtgccgactcgcatcatattgaactagtaagatactgatatgatacatgttactgaaattatggaccttactttctatatatgaaattataaagttgatcatcgcataaaaaaacatgagtgacatcaaataggacatcttgtgttacttgaatacttcgtctagcttaacattttggcgtttaatttatatcttgattgatatgtgccagactctcagatgcttgtaaaattctttatttgcagcttttaggattgcgaaagagttttatgagtttgaggcaccaaattagaagtgtactttagttttttcagacattgcctagggatgcaaccattaaactaaatgtataaactataaaatgttgccatgtttgacccttcgtatccctcttttcatccattcctttgttttcctctttttctcactctcaccaccaaggttctctgtatcagtgttggctattgtaccgatactttattagcatggtacggtgtgaaacgatcattatgatgcaatttggacatgtcgattagtagttactcatgctcaactatgaaattgcctagaatcaggcagtatgggcatgcataacatggaattggttggtatgggtcggtttcacttggtttagattagttttgctcagatattgaactaaatcttggtactatattagtatcttgttggtaagtttgcctagtacagggccatatgggtcaatacagcaagccttgctcaacactaatatcctttttgtgcttgctaagttattatattaaatttcaacgtatgaacttttaacttacacttacaactctgccaaaactcttttaatgctattataccttcatattagggggagcgagaaggaaagagaggaaaagagagggagagaggggagggaaggagaagggagagggagaaggggcctctagaggcctatcggaggccgtcggaggcccatcgagggtgctggaggcctggaggcatcggatcgaacaagggcttggcccttgtttgatcccttttttttagcgacattgggtaaagtctgcaaaagtcggcatcatgatgttaatcacaaaaaaggaaacaaggcccctgttttgattgggaggagggtggagcccctcctattgtcttcactggcctcgacggtggtgggccggccctctggaggccatcggattcctcctttcgttctctctttcctttcctacctctgccctcctctagtttccaatatgtgcagcgattccggcagcctctcttttcttcttcctcttcttccttctcccctctctctctttctctctttccttctccctctcctacttgcccagtatcctgtttttactgtcagaaccgtactggccggccgtcggtatggtttggcatgcctcgaaccatttggttcgggatggtttggcaaatcctacgagacactctaacacatagggcaaggtcagcttaactcttgattggccaaattccttaagtctatcgattttctcttactctggaatgagacaaacacaataaggtaatgcacaaaccttgcttttcctcattgaggcccagctctgtacatgcaggttgttacaatttgttttccattgatgaaggacccttttttttgtaatttctctttttttctttcttttatgctttttatggttcttttggttttatttttgttttggtcatatattaggttcaggtgagtttatttcctttttttgatttttttaatatcaaatattgttttttttccattgtttcccctctctttcttcttttcctttcctttcctcctcttcccctttgaatgccaacaactaaagaaggggactagaagcctgtttcgtgtcttcattggtaatagtctacactggctggttcagtccatgtgatgcttggtagaaaccaagaccaactgggacatcttggtaggagggaattaaggtcctaggtgcatctcagggcccaggtagtgaccagcctgatctattgactagacttaaacccttggttttgactaatggcctctaaatctcagaatcttcttacataggtcggtgatgactgatgatttctctttctgaagagactataaggctctaatataaagcttggatattcaatttttaaggggtgaccctagggttcaatattttgctaatgcgtctgaataaaacctaaaatctcaggtccttagctttaggttcaacatggggttcgttggctatctgggaggttctggttctatcaacaaacctagaaccttatcatgttaaattatgctacaggacttgttcatacgcaaaaacctgataatccaaaaaatattgcatacactatctattgtatataaattatactccgtctctctctaactctgtccaaactgcccagctaaggcctgataactactcattattctatgaatatgagttccgcttttatcaagtatgatttaggcttgcgaatcaggtttacttgcacatggatgatttagttttctatatttacagtcagatctgaccgaaaactaacctgttgtcagttctaatttctcgtcttgtatattaggaagagggttcattccttagccagttgtggatgccattctttggactttatgctagcatacatcacaaacacttatgcattggcatgcatcttgaaggaatcgtgcacaatgccaatatgaaacttatggcttttgcagccaggtgaaacacaatttttgctgatcttgctgatcagctaagctaacccgcttgctttctgaggcaggattaaagctctattttgaattatatctttattaatttagaagtccgctttgaggtacaggttagaaagttcttaagtcaatagccttgttttggagcagtttttgttttctttctctatggtgttctatgggaatccaacattaattttcaggaagtttagattatattgtgcagtgaaagggtcttaacttggcaagaccttaggaatatgaacatggtctactaaaattctatgattcactgaattttcttccttgtcagacttccgtatatggttttaacagaaatactgattctttttcttgttagagaagaatattatgtcctcagatgctgacagcattacataattctatattcatctctcttttcacacctctctctctctctctctctctctctctctctcacacacacacacacattttaatcgcacaatatgtgctatttatatgagttgctatttcgcttccagttcccttagttccatcaaccataaaggtcccttgtgactatcaagtttgtacctggcatatggtttttgagtgtgcttgttggagaacatgtagtagcttgtgtttctttaccaccactacagaattcagatttcaggaacttatttctgtaactttcacttgtatacatgtttataattgaaattttcctacttaactacctttgtcgcaatgtaggtgaacgacttccattttcgccgaagctttggttggggtggaacagaaataaaagtttggtttggaaaagttgaaggcctctctgtttactttctagagcctagtaatgggtaatgtagtaatttagttcatcttctactctctgctggtaatcttttaagttttccaaaatatgtgctttttaaaataattaaaaacatcgttccgtttcacttccaacagtctgttagaatctgctgtttcagcatgtcgtcacctataggtcctatgttctattcatttggctatcttgtacatgtttcaaaatatgaacattttaacagaacttctttcttctgttttctctagtagctatgtcagattgatggttaagcatgttgtcacctgtaaatcctttgtgctgttcacctcatattctttcattggcagatgtctgagtgttgcattttaaatcaaaactatttgccatgttactttcaagttatgaaatcgcattcaaactttattccagctcattgatgctctatgatccatagttccatacaaagttaatccactgtatttttatagatggtagaactggatcccttctagtcttattttttgaagaattgctgccttgtatgaccgagccatcattttgagttgagatttggccataattggcgctcctaaaagtgaactgctagaaggatattaaggttttgaatattcctgttagatgtggcagatttgaaatggttttgctttagaggttatcagttgtgttgtttcggcttggttctactttgagtgcacttttatgggctgtttcccgtccatttctttgcacctccagtaggaaaaccattgtctagactgagtcctcttctaatttgtaacttaggcatcttcctttacttaatcaactatcatggcaatcttttgcccttctttttcatggtatcggcaaattatcgtttgttgtttaatttaatgactaccaataggcattgacctctaaccataaactagccattctcgattttattagtctgtttgtaatagcttgtcaagtgatgcgttcataaatatatattcagattaactaaaggcatcaccttatcaaaataaatccagcttgtgtttgaaggtgaaacttgtgccatttatgtgaggtgagatttttttaaaaaaaatgttcctgtatttgtgtttaatctagatggttcatgtaagttatgccaccaactgtgttaatcaacttcaaaatttgcgtgggccctaggagatgtctggtgcgggacctacatcacctgtcaagctgtgcaagttggtgcccttcacttacacagacatgtagctcttggtgataggctagatcttaggcacattaagctttttctacaagattatactaattatcttaggttcttgattcaaggatatccatctcttcaacatgagcatgtatgcaattttgtacgctattttgtctttttgcatttgcactttgagagatatgatatttacgatcatattgatggaatgatacaaaaccatctactttttgactcctataaaattgtgtgctgctttgacttctgagtttatcaaaaactatattatcattttgttgagccaaaatctgatcttcaaattctcccatttatggacagtaggtgaactatggacctatcttcttagacttattggttgtctactagggtatgtgaatatcatttgctataccataccgaggtttagctcaggatgttcactggtagcttgattcacaaatataatgttttgcacctttccttaaatgaaacaaaaatgcttaaacacaagcatataaatacattttggaataacagcctctaaaaggtatgcttgttgaaactttacataatattatttgtcttaaaaagttgatgcatgattgggtcaggctttctgtggccccaaagaggcttagaattaggcggcctgttcattctttttgctgctttagcactgctattcatggtgtttaacatgttttcagtgagaaacatgccatctgctgattcaaagatggtaaagtccaactcgcaggactttttctggtttctgttctttgctgacagccatctttgggcagaaatgagtgttaagataggagttgcacaaaaggacaaagtgatggaaaattgatttaggaggctcagtaaggagaggtactttaggttgtgttgaagcttgtagagaaaggagaggaagacctgaaataacatggatggtggttgtgcggaaggatatggagaatcttggaattacatcaggaatacttggtgaatgaggatccataaagccaggcctcatgattggcaaaaggctggatggttgtggttatggttatttcagtttgttttagttttgagaatgaaaatctggtgctccctctcctcacctgctctttcttttccatctttgcttcttgattttttccttcactttcctctggttgcagctatctgctgaaactgtttgtcggcataaggaaacattgttgttcaattgatcttttattctatttcctaacagccaaaaataatgcaagaataaagaaatatagtgctgataagtcagatctgttctttcttcttccatctcttgtcttaattttcctttcttctgcattaaagttagtgctgaacctttcattttagaacgtgaataactgacagagactcattaagtacctgttcagattttagatcaagcattagaagctgttaataaaaattccattagcaaatacaatccttggaaatcgaaaccatggaaatcgaaaccacagtgatctctaaggtcttaaccacttcttttcctgtgccttaaattctagttatgatctgcaaaagcagagatattgggatagcaaccgcaaaaatcctctaaagccctgaataactcaatttattagcatatcaaaagcttttacaatggccaaaagccctaaaacttcatgaaacttgtttcttgaggagacaagatggtacatcttgaaagctaaagattcaaatataaaattctcgactctcttcggcctctttctacagacaatcacaggaagctatgtttcctgaggatatgtgggtcctaatgtttccattgatgtccttacgaatgcctagatgtatctacattagtctatttaaaaccatacagaattatggaactatcctatttcttctaagattgtatggttattgtacaacatgataagaactaaatatcgacttcttcctcattatcccatttcttcactgatttttttggtacagtcttggattttcatttcatcgtaatcatatcttcttaccatgtaaacctattgttttcaaaacaataccctttcagattcttgtgatgcacgatgtgcttattattttgcatcattattctttttcttctgtttgtatttggatatactgacttttcgtatcattcttggcatcattgcataagtgtcttggattagggtgatgtaaatcttttagagagttaagagattactcaaaagttctgttttcttgatccttatagatactgatgcttccatgttatattttgagttcttattaaatagttaaaagctaaaaaacagactttagtataaatggattaatatatagaagaaattatggctgtaaatttattactttttacccatgaacttatatataacttggattttgtgtctgttatatgtaattttattgtatacaagttctaaagatcaaagtttagaatatctagtaacattctttcctgcaacagagtcacttttatgaggatacattacctttttgttttgcagaatgttttctgttggatgtatctatggcaggaatgatggtgatagatttggtttcttttgtcatgctgctcttgagtttctactccaaagcggatcttgtcctgtaagttaaaagatatatgcatgcctgtgaatattaattttttttgaaaattttaatatcttttcatttttattctatggtcacatttttatatgctttgttcattttattcgtatatgtaggagattttattggcatagttttatgattttcatcaaccagaaatattaccttctaacataaaatgcagaggcagtcatatagatgttggtgctgatgagccctacttgatcgatcatgttggttaaataattgaataagtctgcatataatggttcagatttcagaagctgagctatgctgattattaaaaggcctaaatatggatgcttgataaaattagtaccagcatatcaaatctgaagcaacaaatcatcatgagtcgaaggtacaggaaaggtttgaaaaactgatcgtactgcggtaggatactcctctactgaggtataccatggtatattgaaggtgtacagtatcataccatgctattttagaccttggacaaaccatgagtatgtatggaggtgtaccgcggtacatgccatacttagttttgaacagtacaccctgtactgagtatttcaaacctcgggcaatgtagtagttcaagttacattgcaatttgcattggctcaggacgtttgctatcaaaataatccttatgtcatgtgaaaagacaggtggctaattataacactacaccacttggttatttaaactgaacaagcctaacacagtcatgatgtgatggttgagacacttgcattaatgaggtgaaatttctcctttttcattatgtttgtgcatagatagcatgagatgtaattccttagaatggtaaggcgttgtaggaaatgcagctgtttgcttagtcaattgagagaagtgtatcttaaatttattttttcttaaataatagtcagcaatcgcttttggtgactcattcacatggctgcaagttatatctgatgaccataatattaatatggtagcagtgtttgtttcttagttgcttgagaaatgattcattcaacactaacggagatatgtttttatctcatagtttttgaatatgtcattgactcgaggaatacatgtgtgctaatatcagttactgacacttggctaaattgtttagaccaagtcatgagtttaaatatgagtggcctaatgggtgcatgtgattgttgtcaggggacacatgagatgcctcaattagcaatttgtgcagcttgaagctcgggccaggtcaaataaatatctggggaaaaattgcgttgctaatcatggtctttgaggcatggacacagatatgcaatttggattcaacatatgtagataggatacaatcgttagaagtaggatatgatatggttgggatttgacaataaacaaaatattttgtatatgtgtaagaagcatccatacagtaacatcaacatctacaactctactggttagctactgtttagatctgtcagccacagtccataacaaaataatcagaagaagccatcacttattgcagatatttcgtattttattctttagaaaaaaggaaacatgtgggtgactgttaggaaaagatggttttacttttaccgatttttgattgttttcttttcttttatttttttcttttccttattttattactctcagactattttttttctttgaccagttgttctcttcgtcaaagacctctctccctaggttagcgagtgtgagaatgtggtaagatttgttgggtaacatctctgttggttaaggttagtggggaacaacccacatttcctggtgcaattcctataaaaaatgtgatatgatattactagttcccaccttttcccaaacttgtcccagagcttctcctttctaaaacccttattcccacactgttttcatgcattctgctcataaacacttcagtgagtgttaaccatataaattctttgctttgttccatctttggatgagaagattggttcagatgcttctttgtgcagtggagcaatggtgaataggcaagacttggtcgtatcttcagagaagattgcgagaaacccatgcacagagccagaattctattctcttaggacagcacccaacatgcttcaatccaggatttcctacaatttttctctagttctttgattgcttagatttctgattttagtaataattcagcaaataatctgctagaatagatctaagatcttgttttttcatattgcatctaagatctaagctccaatgagggtactaacatgatgtcactcttgctgtaaccatgtctggtgatgtagattgatgatagaattgccatttttgtacaatgacttgtcaagtttacttagcaaactgcacatctagctccattggaggttctaacatgatggcattcatcctgtgaccatgtctggtgatgtagattgacgatataattgccatttttataaaatgattcttgaagtttacctaggaaatttgagaaggggattcttagatctgacaccatgagattatagaaaatggttgcaaagattgcaagagtgtaattgtctgttaaatggggcatgcagatgatgtatcattacaatggcttataactatcatgtgtagcatgtgggtactgtaaataaaattccatatacatgtaatccaaggatacaagcttttagaaaactattagttgtctattttccattttgctatactttcattaaagcatgtacctcttgcagcaaaatacctctttagcacctgttcttttgtggataaatatcatgggatagttggtcaacttttttattgaccaacttactcatgttctcatacttttaaggatggataagttacttcctcatgggtagcatttacctatgaaatggaaaaaaatcttacccatctagggggtggctaaatcatttttccatcaatcgaaaaaataacctctgtaattcattcttaatatatctttaaccttataattataatataatatatcatatcatatcatattataataatatattatataaatattattagataataatataatataatatagaatattatattgtaatattataataaattattataatataatactatagcaatatattatattatattattatatataataatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttgatttttgagtgtaggttgtcttgctcggttctgctccagatcctcgtatacaaaatgattttgttaatttggcaaatcaattgcattcttcgcattctgactgtgcacgcctttgtttaacctatgatgagcctctttcgcatttggtgagatttcaataaagttttagtgatgcttataccatgttacgcttagcaatacaaaatcttttacattctcatttccccttgttagatatatgccggtgcggacttcattcttgttccatcactttttgaaccatgtggcctaacccaacttattgctatgcgatatggctctatccctgttgtacgtaaaactggaggttagtgccttaaaagtccttttttttgggttttcttattctagttatcttagctatgcatcctgttcaggttcttgtgttgagtttctttctctttttttgagaacattgtatttcacagtatcatattaaaattctatcaaaagcccatgaaacagtggttgtgtccagatctgaattttgtggatggcttttcggatagagcaactgttcctactggtcttaataaccctttttttgtgtactctccctttctctcctagattccaccttaatgtaataatttcttaatatcttgcatgcataattttaatgtcatatttggcggagttgctggtccaataagcaatgagcaactccattggatgtggagtgatcatatgacatgcagatcagacaattgtcacaattccagcatccagttgactttgtggtgtcaaccaagattttaaaagctgataccaaacctcacacagttttcccaccaaaacaaaatggtatcgggttacgggactggtgttgacagtatgtttggaaactgaaagtatcaaaaaggaatgaaaaatcatcagtatgcactgataggtcaggtatgatatcaccaatagacaccggtatgaactcatactgaccgatgcatacctgtatgggtggttttagaatcttggctcttatactaatgtcagtttcatatactaatggcatgatactctgctgttcccattctggtggttttcatatccattgtgtcaagtgtcaactgttggatcacatatctaatttgttagtgcttttcttggatgttcagaaatgctgtaaagaattccaggcaacaaattttactgggacattatgcttttctaaaaccattaggcattgaattgtgagaaaaatcatgattttaacatagataattacagatatggccatgatttagtagattgtttgtgtagggcgtattggatttgatgtaaatatgccttattacttgcctattctgacatgtggtacagcaccagtggctagttatgagaatatggatatttttcttgtttgctcatttgaagattctaaggtccttgacacaattaatggtattaagtatactgtcagtttagtttgtattggctttgatgtaacttggccttaagaatcaagacccaagtaccagcgtagcatgtgacaaagcataagttgctaattcttagaatgtgggtgttgctctgatgagttatgatatcttaatatggtaaacaaagaaaaaggatgttagaccagactaagcagtttgtgaacttcctttatttcctcttttctctctttcccttctgtccgatttttattaataatttattcagtatttaatcagtttactcttcttatattttctctcttttacttgctgattctctaaagggaaaagcctctcatctgttttctatcatgaagcctttaaaaatgatctgttgtctataatctctttttctctctagtttatttcgagttcttctatatgttttcctaatatagctaagagatcactggaattgattaatgaacgtaagccacttttttcatgcttctctttgatctctagatcttatgcagatttatgtattccagtcattttataattctctagttactatttctcacatataggcatattagatttgaggataagaggtcaccctttgcattttgcaggactctatgacactgttttcgatgtagacaatgataaacaaagagctcaggcacaaggtcttgaaccaaatgggtttagttttgatggagcagatcctggtggtgtagattatgctcttaacaggcaagtatcaggacttggtttaatatattgttgcatatttaatgctacaatatgtaattataattatgaatttcaaaatggatgactaagaaagtcttttgtaggtgataatgcagttcatatctgtttggtttatttttatgataattgctttatcattttaaaattaagatggtagattagcaaaatgtgttggaaactctgtttgacaatagtctatatttccattaagaacaactatttattgtacatgacaaagtatctaatactacagaagtattttgtttcctagataagtaatactggagaactctcgggaaccttaatgtggtcatgtctcgcaaatgtaacgaacctgaggatttttgtgatgcaaactattttctaatatgttatgcttccaaaaaatatcatctgaaaattaaaatctggaactgctaagcacagtaaaagaattctaaccaacttacaagcatagtgcgtggaaagtattcaatgcatgcaaattgctgaaagttaatattaatcaagtgtttgtgtgcaaattaagcatgagatcagaaaacaaatcattgaaaattgtgaattgttgaaggactcatgctgatggatttttattaatttgaaatgggacacttgcatgccgctaaatgacaatgttgcatctgggtccttgctgaaagttaatattaatcaagtgtttgtgtgcaaattaagcatgagatcagaaaacaaatcattgaaaattgcgaagagtgttgaaggactcatgctgatggatttttattaacttgaaatgggacacttgcatgccgctaaatgacaatgttgcttctgggtccttgctcttggattgcaacagttgctacttaattgagcaaacacatcctttcatgaatgacagaggagatgcgcagaccaaaggtttgccaaaaaaaatcaagttaagggtatgatgagcaggaaacttgagggataatttcagatcttccgaagcatgcaaaaccttttgtgtgtaggtacctttccagtatggtacagtgctgtatcacatgcaatatgcctgttgaaaccagcataacaaaaaggtgtataccgtgccaatacagactagtactatgagccacactggcaatagtaccttactggcatgttatcattcttaagatttttttttttggctaattataagataatatctgtttttagtgaaagatgaaaatgtcaaataaacaatttcactttattcgttaagggaattattgggtgtattttttttcagagcaatctctgcctggtatgatggtcgggagtggtttaactccttgtgtaagcgagttatggagcaagactggtcttggaaccgccctgctttggactatatggaactctaccatgcagcacggaagtaaaggcatgcaagaagaacgtatggtaagcgtgatgtaagcttatataattcttgacagtatccttgtacagtcttttggtcttctgattcattttttttagttatataattagcaggactagcttctctattttcagcatatgtctcacctctcaataatgtacagagcaagagctcgaatgtttcaggcattttatgcattttggttgcattttaaattacagtcatataatgcaaatttgctgcttattatctcaggaaaattagcttatgcattttctccggcgtggttgaaatccttttaatatatgatgtccaacattatagttaaaaacgcccacggagtttgacaaaacttctgtaaaggcagtattatcatagagagactgcaaggatggctccaagttaaattgtccttatcaattcgataacctggcgctgatcgtgatgcatatctaaaagccataaagccatcagctctcttgtcacaaatttaacaagtatatgctcccttgggtaatgatgcaacgaaatctatgctttgctacagcttttgtatgagtggtctgaaatgcctattggtggcacaatggacaagactattttgcttgggcatatccagtgtgatgaggatttctccttggcctattcagagtttgatggaattttaatttatctaatggatctcatcaagataattaggctgtgcatcttctaataattgcaattgtaaactgatggttcgaccagctttatgcctttatcccacattgatggcactcttctctacctcggagaggtctagggtttaaaccaccatatttctcaaaatacaatcttacgctaacggagaattctaaattttcctatgctaatcgcttgttacgaaattcatggaaaagagaaaaaaatgctgttttttcatagaaagttattagatttctaaattcgttcactttctgatgaaataaattcaggaaaaatcagttttttttttaagaaaaaacattctctaagcaatttttcatgcaacaaaaggaaaggaattcctttcaccaatttctccacattaacaaggtgaggagataaagctaattcaaagctcggtaaaaataagtgaattttgttatacagggttcaagaaggacgttttaaatgaattctcttatttaaagctttcaagctgttgattttatgtgaatctagtggcttggggactataactaatttagatgttcaactttatataaaatgttgcccatggtattaagttggcaactataaatgcatgaaattacatatcagtccgaatcgatgagtacatcgtgtatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctcctctaatcatgccttcccccttttccttccctctcctctctctctctctttcttctctcgattcgcctcattttctttgtgttggttcatctcagtccagtccgatatgtatccatatcgatctgtaccatcaatcgatcagcatgggcttcgatatcgagttcgcgaacattacctaaatgactcgataaatcggccttatcatcttgctctatgaatgaacctgaaatatggattgctaggtcttttccttcgatattagaccaaatatatgtttgttaaaaaagtttctaaacccaatggacaaccattgccacttaaagacatataatatgaaagaaactgcacatttgccaaagtttaattattgaaaatcttcatcaaaaccatcaagcccttgctcagatgatatcattcctcacctcttggccaagatgggagtctacctcttgttggattcacttgaaggatgaatggacacaggatagaatgtaagaattagcctctcctactcgtacatgcgcgcatgcatgtgcatatacatgcaaacacccattatcctcacgtacatgtgcatgtatctccataagtggcagtgtatggtgtgatgcatgatattcctctcaatttcttataacaagaaaattaatcaagcttaataatatcatcacaacaaatctccctaccatgtagaagtttaaaaacaacaattagtactcatcctgttaacaaaaggaaatgactaggaggaagattgagtagtgcctctccaatgccgttctagagatgacaagcacggaaaggaaggtgttgagaagagacaaatgtatcaaatgtagtttaatactctctcctgtgacaaagggaataaaaatgaactcgaacttgccgaaacaaacatgcatcttgcttactgaaaataaaccttgacacaatacgtatatgttgctgatcggaagattagatctgtccaattcaacacgctcaatcagagagactctaaacttgagcataggtgaatagatgtatagctaatgtaactgaggtgcttgttgttgcatgaaaatagagagcaggccataattgggttatgcatagaattgggttatgccctggatgtgatcacatatgaaaatatgggtaggcaaaatggatatcaccaccgttaggggtgtaaaaaaatttgattaaaccatctaaaccgtccaacccgatccaaatcgaaacaaatatgatgatttaactgattcggttcagttgaataaaatagaaaaatcgatatttcgatttagttattgatttattgatatatgtgatccattggaatcgaaccgacaaatcgaaattaaaatactatcattttatatatttatatatatatacctatattacatacttcatatatttatatatacacttatgttacatgcatattcaaaattagattatgtactttatatgaattaagaatctaaaatatttatttgatcctatttcaatccaatttagatcaaatttgatttaattataaataataataaaagaataaaaaataaaaattaaatcgatcaatctgcttaaatcagaaaatcgttcaaaccgttcaaatacttgaaaaagctatatgaataaatcgaatcgatagaaaatcgaaccgaagaaacagattatatttagtcaaatatttaattttagaaacttcttaaatcgaaatatcgatttagttttaaaaaattacttaaaatcgaatcaatcgaactatttttaatcctaatcactgtaaaattgagaattgagtgagaatatacggacaactagaagtatcaaatcatcgttgttaagttaaaatgatgagacctgtgatatcttaagctggtagtaaatgacaaatcttcaacaaaacaaaatctagtgcccttgaaatggatggccatgattaatttatgtgagcaacaagatgtatagatcaaagatgaaaaatgaaaaagtaaattattcagactcttcttgagatttggggtaattacgtgatcccaaccaacgttttaaaaatacacatgtagttttttagtcaaatataaaaatttaaaatataaaaaataaaaaattattaaaatataaaatataaaatattttaagattgaaatagattagatagtaataatgttaataagatcattagtttatttaacagaaagatattcatgatgaaattatgtgttatatatatatatatatatatagcaatgcttaggtggtagaatgtatatttttaaacagttggatgaggatctgcaactacctcaaacttcggaggaggatactgtaatatagttaaaataaaaacattcaatgctcctctcacgtggacctcgtgtgcaaaacgacggtacgttgtgtctgcggtggactctcaccggaatccactggtttctagtttctctctggttcgccgacagagggactgagagagagcacacacctactatctttttgcccaagaactccgttctcgaatctgcgagaaagaaaaattcgattttttttcccctatcagcaatggcgataaagacccccattggcgggctgaggctggcctccccgccctcggcctttctgcgagccccttccaagagggccaccgtcgcttgcccacccctccggacctccttctttaacggcggaggtatggatcccatctttgtgctggtttttcgatgcatcttggctctgatttcgatcccaccgccctgtttagaccactttgatggcgaacatggtgtaagccttttggtcggaactctgaaccacggctgaaaacaatcagcggcatctcatgctaatctttgatgtttacttgaatttttttatcgattaatggtgaatttttggaagggttcatgggagattgtattttgtttgatctgttgatttaaagctacatagatgatgattgagggttcttgagagtaaaaacttattataaagatgaaattttgaaaaaaaaaaactttccttctggcatgttttggaatttagggtagattatgctgtactggctgaaggagcggcataaattatctggacttgttattgtatacaccacggtttgccattgtggattctagacgtgtttttccggtattcactgaattttttagttcaacaagtggtcgcgatatagatgtttgtacaatttcttttgttgcaacgttttctttctttgtcaaggccatatggaacttcttgtttttatgctttacagtgggtgctttaaaagctgtagagattcgaacatccaggtttaacagacagagatgtggtgggcttcgtggaggtggtcttggtgcccagatgaacctatttgatcggctgggtagggtaatcaaggtgagatttaaagacaaaatattcgacgatgtcattttatgatatcaattgctaattccttctgattctttcaactaattaatatcgtttggtaatcctattgcatgtgtagtcctatgtaaatgccatcataagttcttttgaagatccagaaaaaatattggaacaagctgtaatcgacatgaacaatgacttgacaaagatgcgccaagccactgctcaggtttgacttttagtacctccttgatatcagcaagtatatatcttgcatatagtggagaaaaatactaatctggccctgatctacactttcatgcttacaccagtctgccattttttattcttttctttttgtatgtaatcttttcacatcattcttctatgttcaaggtattagcatcccagaagcgtttggagaacaaatataaagctgcacagcaagcttctgatgattggtaataccatgtttgagatactactttcctacaaagttgatatgtgtgaataaaacctttaactggcagcttaagttttattaacaggtatcgtagggcacaacttgctctggcaaaaggagatgaggatcttgctcgtgaggcccttaagaggcgtaaatcttatgctgtaggtattttttttagacgttaataaaccataattttgaaagcattgctattgttattatttattttcatcttcagggaaagcctttgttgtaaactcaattgcattgctaaaatgtagtggtatatcagtttcaacatagccttcttaaatggtctgtcactgcaataaattgaagaataaggagaaaatagaggacaaagcattaatagtgtaagctactggtagtctgatggtctccatttgcaaatagatagaaggtagtctctatattaaattggttctacaactgtctctgagaagtgatagtttttattcctacaatcagcttttgctttgaaactgtaagctatcttttctctctggatcaattgcacataggacaattactttgagagttttagggtcaagtgagggtcacccccttcattttttatattttattcaacttccttaacacatgtttgagagagttgacgttaatttttcgtctgatgattcaagtgtaagtagcatttagaccatctaatcctgatacaatatgtcaattgtatcttaatttcttgggatatgccttggtcagtcaaaaattttgaaataccagttggtttttgatcatggagagtgttattaaagaccaagaataaaccagcaagaggtgaaaacattttaagacatgcagaagggaaatggagaatacgctgaaacaagaaggctaaataaaagcaaaatataaatggagatcgtacgaaaagaaaaggccaaataatagacaaaatattcttgtttcatacttgcatcaacagacatattatataaagaaaggagttttccaaagctgagagcatgtatcgagaaatacctggagactatttcttgtcttcccagcacgaatggctgtgatttccaccagattaaagttctatagatgtgcactttctgtttttgtagcaaaattaaggtgtagatttgtaatgggcatgattgtgcataatttatccatgtgctaaacataaagaactatacatacatgcaaaaaatcctttttgggggattacattctgattaaatatatctgttatatacatgtattttaacttagctgtatctgagtggtcggtaaatattgatttatggagtcaggatctttcagcaaccacatttatatatagtttctttctttctttctttctttttcttttttctttctttctttttttttttggttgcctctattagtcacttgtgtgggagattttgctcttttagtagaatgcaggtagtgtaatatagaagttaatgatattggcaaaatcagatgaccctagagatagacctaatcattgaactacataacttatattcttaagttctgtcttattttaataaactaaaaatttaagatggtttaaggcattattgacaagttacaatactttcaaagtctattgtaacttgtaaatatatactaaactcatttatgaacaataattgaagcattgaatattcatcattattttaagctcaaatggcagagacagctggaattcaattgtacaatttggtggagactcgagcttgggtgcagggattgaaatgaaaaaccttttgtagtaaattatttaacactttagctaggaaattcccaagagacaaatgttgtttgcttctagtgtaatgaaattctttgggatccgatatgacaaacctcattgcttatagaaaaatgttacaagaaaatgctttctgcacaaacacacacacatacatacatacacacacacacacacacatacatacatacacacacacacatacacacacacacacacacacacatatatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacacacacacacacacacacacacacacacacacacacatatatatatatatatatatacacacacacacaatatgtgtatatatatatgtatatatacacatatacatatataaagtacatatttatgtgtgcctgtgcaagtgcttgtgcttttatatgcattcatcctgtgcgaccacctatggtatagttagtataatttgtggtgataaataggaacactactcctttactattttgtctgaaatttaacattaattcccctttttcttttaactgttgaggttctaattactttaattaaacctttttttatctaggataatgcaagctcgctaaaagctcagcttgatcagcagaaaggtgtggttgataatctcgtatccaatacccgggtgagcatactatctttgcgaggccatattattattgtagttccttttacctgttaatgctttactctgatgaggcacatttgtcacctcaaactatgttctttctctgattttctctttaatacttagaaactatttttactgcaatcacccaatgatgtcttgatatttatgacagtgatatatttttaaaatctttactttaatatttggtagcatgttctctttctaggtaaaaatggtcaagttatttagagactgaagtttgaataaggaaaaatacgccttaacaaactgacaatttggacaatgaggatgaaaatagggattgacttgcccaacttccataggtcgaacatgctgcccatctgctttgagagagagctacatgttctttatatcatcagctatgaaagaaagcgaaaaaagtctttcatagccaatattttagatactctagctatcgataattccttagatgagcttttgaagtaccttttggaaaaaatagaagaactccaaaagcacttcaactggggtcagcatagaaagtttgtgctttatgactaaagcacaaaaagagaggctttattcagtgcgatgggagtttggtaggaggggtggtaacaacaattagttctataatttcagagagagagagagagagaattgtcatataacctatttgaagccaccacaggtatgcgaatgatgcataattatttccgcattagaggagtagctgcaccttaactttttgtaatggatgcaacatttgcatatctaagcatggcattttggtttctttgtaagataattttggagaatactttggttgaaactgacgagtttcagagaaaataaagaatgtatacttttggttaacttgtgtaagatagtattctgagggcaggtttgtgttcttattttattctattgaagttttggatctagtcagactgacttcatattcttcgatctcctatctattttagttactggttgtgagaggatttaaagtcattgtgtcctggttctataaaatgttaggtgtcttttacatttggctccatgaagaacaaaatttatttattttcctttatccttaattccttattattgtgttcgaaatttctatacaaaacaagttaacatcttttagtccaaggtttaagcctttacttctctcttcaggtaaaaaggttctttatttaactatctattttagtttcagttgccatgcaagattaagggcagtttagatacttcgtttctttgttcaaatttgaaatttatactccaaatagggttgctatatagactaggttttcctacattaaggtatcttggtgaaataggaatcactaagttttttattcatattttaatctttgaatttacttgaagggttatcaccgagtagtttttgatgagataggtaatatttagcatttgaatcctttaattgggaagatcttgaagtcaataggattaagttttgaaaatttaagtttccccatgcatgggtttctattggaccaaactttgtaagttcttcctttttatatttatgttttatctttttgcaagtctctttacacaaaggtccaaattccattatactgagtcataataggagcatcacttgtttccttgagaaaaggtggttcttttggttcgtgttttttttgctcctttggctacagtcatccatgagtacgtgactcactgctttattggcaaaggccctttctttcatgcttggcatggcaagtgctagccgatcttatgtctagtctatcatctagagcaaagcttcaaaggcaaattgatcagtagccccataaataaaaaaaggaaagaaagtaccagcaaccttctcaccaatgtttaaaaaatcgataccggtgactgtctcgatcaccagccgattcagtacggtaccgaaccggtaccatacctatacggtacggcggcgtgccggtacggtaccgaaccatttccatacctacacatggtatggcggtgtgccggtcaaattggcacgccaaatttttttggcttttttttgcatggaaggtgtccaatcaagtttttataaattattaaataatttaaaatttaaaataatatttagtgatattcattaatgtctgtatcactctgatacatttttaatcgcatgtgacatgaatctaagcatgacattatgttatctagcatcctaaataatcaaccatggactagatattattagattctaaaatacttaaattaattaaaaaatctaaaaatactcaatacgtattgatcatcagaatctggtcaatcgtcgatgtccataaatagtagaattatctacatagtcaggagaaacatcagtccatccttttagctacatagcattataatcgtttgtgttcattccataaggtagatgcattggattataactcatctttgatccctcactgagatcctgactctgagagctatcattgggttgatagcctgatcgtgaagggatccatccaaatatatcggcagcaaagttcgatccataagacgctccgaattgcacaggatagtagccactagaagatgatgtctccgatgcaccatatccatatccgtaaggatcataggctgcctatggctgcggataagagaatccagaatataagaacaaacctgatacatctatggatcctattctacgtgcaaggtcatctgtagctgcattatatcctgaacaaccttgcagagcccgtcgtttttatgaaatcgtatcgtcatggattctactagcttgtacactgtggtccctatcctgcgtggtgtgcgtaaactgaaactcaccagtgaataaaaaatcaccaaccggctgcatctcctatcctccgatccctctatgatcaccagatccatgagtagttgaagaactatcatcactgctctgtctagtgttcgaattcgagtgaaccgaatgcttactctctattggagttgcaactatcttttcttttcttgtctctgtgcctggcagttgtctgtcctctcatcataccttgctctggctgcaagggtggatgctgtggcatatcggttggaggtctatgtagaatgttgctacttacctactgagaggcgtccaccccaatcttagtagcaataaaactggcaggtcgtggagacgattctggctcatcaagctctgactcctgctactgactcataatccatccgatcatcggatcttcatcttcattaataaaatcactcgtagttggatctgagtacttcagctgaacttccttctcaatacatttgagcctcagcctcaaattataatgcacgtacacaagatcattatggcattcctattttagacggttcctctgtttgctatggataaggacaaaggtcgatcagttatgctcacatccacttgatgaaactgtctggaagaggatcttgatggcaaagtctttcaaatttcatgcgaatccaccaaaatgcacccatcattcagctgtaaaatcattgaaatttagcaaaatcaaaaagatgattgaatatatcaatatgataatatatttattaatatatatttggattcatctttgatttgtttcggatcgctgcattacttccaaataattctgtgccctccttaaatatttttgtctgtaaaaaaattatttgttataaaatcttagctgttgaagatacagctaagttaataaatatcattgaacttaacttgttcaagatatatagctgcggtgttcatatcaggctccatcttatctattatatttcgtagggaggacaaaaactcttcacccatgccaataccaggtatggagtactggaatctcggatttagataataagctgcacaagtgcacatggattttcataattgattaagtttatttatacagattttgaaagagtttttgatttgctgcttacctgctaaatgtaactctttatccatttgatagctccatcgatggtcgatgatcttgatgtacttatcagcatgctgtggatctgccatcttgatttgttactttgccctctccatcatataatacaagaagctgatctgggggtatcgcttgccatccacagtccgaagcacttcttatagaggcttgatagctgctactatcttcacgatctgctgattgtctcgtcactaagctctccacattgctcccctcagtgtttgtccttatatatctgctttgttgccactcaggactgacaaacatctgatgtagatatatctttttttttatcagactatcaagtgctatataattaatagcaaatcttgtgacatctctggtctcaatatatcatccctagcaaactgccgcataaatgataggaactaatatatgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcataattttgagaaatatatcttaaaaagtttaatccacgtatttcttgagtcttcctacgcttctcattgttagggagtaagaaacggagagcgagagcctaagaaatagagaagaagtcgaaaaacttcttttctatctcaacttatgttaaaagaaagccgaaccggatggttcggctcggttaaattgcgtatcgcccgattcacactggaaccgtccggttcaaggccgaatcgggtggttctctttctttctttttttttttgtggtcaggtgctgaaaactagggccaaactgatccggttcagtgccgatttggtttagcacgctttgaaccgggcggttcggtccgattttgaaaaccatgcttcttattaaatctataatacatctctactcaagtggttttttcttcttccattgtatgactccatgctttgagcaggtgacttcttccactctagtagtttgatgataaagtaagctatcgtctctttgttttttatattcttattatttttccaaacttatctactttctctttgatctttctactacttatctgaagatctccttgttgtattcaagtcttatctggctgttgtctatccccttagccatttctctttttttgatggttttcttccattggtagtttgatgtaccccataacatgtttgctcaaaggatttaagaaatttagaattttaaaagttatatcatgaatctatcaaagtccaatcaaaaagtttgaatttttttcatttttccctatgtccagagctacgcatatgtcttattatttttcttggaaatgtttcttccattaaaatgtaaggaaagagggggggagtgggggggcatcttttcccttctattcctctcaaaaaagaaaagaaatatttttcttaaaatgccattaggctggttcacttttaactgtattttaattgtgattttatgctataactaccataaatttcagctcggcatagtaaatctccaactagttattatgattgttgttgctagtacctttctacatcaattttggcatcaaggattcatgacaaaccttgtcaaactggcatcgcaggattgcagttattgctatctaacatgaacaatataagctttcctctttcaggtccagcttactccaatagggtcttacatcccttgggggttttcaattgactaatctgtccaaaaaatgtggactagcatgtgactagcatggtcagatacccagtgtcagtatggggtatctaccaagtaccgtttccctgccagtccatcgtctctttaggtattcaaaatattaacatttgtgagatacatggtttaaagtttcatcaggaactctgaaattgaatcttaagtttttagcttgagtcaaaagcaatgcaaaactagggtcggatttagaatttcagtcaaactaactaatggaccaaatttgttgtacatttacggttttcctttcatttatttattattgaatgtcagaatcacgttctttagaataaacttagaatttgtgagttttaagaatatctagatgtattgaacattagttttaaatttggaggaaaagtaaattttttgacatgactatcctaaggctcaaatatcacagacatgtaattttcatttgttatattgtgtttaaatgaaaacatgatattacaccatgaacaggattttaaccattttgattttttttttttgaatatcttttttgactggtgcagtctaagaccactaaacaaatgttctctaatatattatatcttggtttgtatgaattttctttatttttttttaatgttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgttaaacaaattgttctcatcatgatgatataaaaccattgagccttttccagacaactttatatattatggattcacattcactaattattcttgttgaggcctatctcctacgttagtgcagtcttttcccagtaagctttaaaaaattggattattttaaaatcattatagaatcattggtgtttctttttaataatttgctgttggcacttagaaaatttctgtccattaagaagattccttccttgaaaggtagctattttacaatctctctctctctctctctcatgcgcacgtgtgcgcgcgcatccccttaaaggtgataatcttgatacccttataaaggtaatgtataattggagaaaattattgctgaaagaagcagacctaacaaatgaagactaacctgcctagtaggaagctataagtataatacaacaaagcatcatctattcctcaaatagaactaaaagggaaagtaacctgtgtactcacagagagaatagcttgacagccatgtacacatagagctcaataaaagtgtttgcagcccataaaaaatgtaaagtatcagtcatgggggaggagagcatctctgctgtaattggaaatccagctcattgtcatcctgaaaagtatatattttcctcgcaacacgttccatgcgctggattttttttttttgtcaaactctcattattcttttcattcatagtccctatcaacaaaaagaaagaatttgctgtatgtggaagattttaagccagttaattgtcatacagagtatctaaggcatggttgtcgtaccacgccgatgctcgatatgctgtttcataccatgctgaactatatactgacaatataataggatagtaccgctatgggatccggtactgagatggcaaaccttgatctaaggactttataaaagcaagatttgaaaattcatttcagttggccctatgcaatttcatcaattttgctggtttcaatatttgtacttcaagattcagagttttggttagaaaaaaggattaaaaaaatcaaagaaaggaaaaatagaagaactaaagaaaccaaggatagtcaatgtacaacattttacattagtttctgttatataggttctttacatgggtagtattatgtacaagtaatttcataaggtataccagattttctgtattataaatatattttatttagttattgaactttattttgagctatcataaagctttattttgtctggtatgctcaagtcttttattcatcaattatagtggaactcactgatatcttgaatttgagcggttgctgcatttctgtctcatgtcactaggttgattgggtacttaattaaatgcaagtagctacagaaaatcatagttgtgtcgcatttttttttttaaaaaaaaaaagatgccatgctcgtgagcggtggcatcttgtgtatacttatccacattagcctttttagagtgctgtagtagggcttttctagaggctaggcctaccaaaggttatatttatcatccatgtgtcaatatctgctcctttaactcaataagaaagagaaatgacccagagtttaagtaacctgtatatttaaggaaataaggaaatgactctgtatgatagtgagtattgatgtcatgcttaaaaagagcatttatgctactggctagtttcagtagtttggctgcaagtgactaatcactaaatcttctcagttccagtcaaaagcaatccaatttggcttcaaatctgtcaaaggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatgcatagcaatgtttgcagctgatcacatcccctctctaagagggcaaaatactttctgaattttggaatgagaccctaacttgaaccctctatatggctgtttccacatcctgcaggcaaccctgaaaccaaggaatgctgatcagccatctcctcttgaatcctgtacatgatgcatgcccgatgaatatttattgtccttacccagaattttgtttccatagaccaagcaggcaaaatttttgatcttgagcagtgacagccttccaagcatacttgaagtatttctcacagctctgctggcatttaaggtttggtgggctgatttagtagaggagatatgtctattatcccattgccagagtaagtgtgctctgttccgcaatgatagggatcagaaacgagattatacagcacaacctttccagtagaaaactccagctgcctccaaagagaaatccttcacgcttccgtgggccagttttctatattccttgttcctaaaagcatcaaccaggcctggacagatctcaccatgtggaagttgcgaagatacctgtctctccagaacacaggcattagatgatgcagttagttaatggcactgctgatttagcatctctttccatccattgaaagcatagaaattgttggtagagagctgttttagatttggggaaaaaaaatgtcaaagaaattttacacagaaaactactcaagaatctttgcagaatgattatctttttaaatatatttctattctagagaaaactttgtaaatttatctcttttctttggtaagtttgattacaaggttacacaagattttttctcagtttgaatacactgggagacatagaggttatttgtatgtagtacattatcaatgtcttgatatctaatcatacactgtgtggcatctttgccccctttcaccattcatattaatggttcagcaattatgacccctcctcaagccccttacattcatattaatggcacagcaattatgacacctcttaagccccttacattcatattttcctttacatggcaatatatcttgttggcatcatatgaccgtcttttggcaatatgctttgataactgctatatgagttgaatatcttttgttagttgactgattttctgtttcatgtagcttttggagagcaagatacaggaagctaggtcaaagaaagatactctaaaagctcgtgctcagtcagcaaagtctgttcctatatatttttatatatgatatgaacttttcttataacggtaccttaaatgtttgaatacctttttaccataggactgcaacaaaagtgagtgaaatgttgggaaatgtcaatacaagtggtgctctttcagcatttgagaagatggaggaaaagggtatcctcttatgactcctttactagaactttctacatcacattttatataacttcttttattggtaaaatgatgtttgaacaatttaaggcttttttttttaaaatacacaaagaattttgtaattgtgctaaacatgatccactacttgaaggaggacctgaaattccttgtgtttcagttcacaacaatatatgcagcttcaaactcttgagtttggacatatacccatccaagactctattttcttgcttacacagtataggaaaatggactaggtcattttagcctggaccgcttcaagtttttctctatgaccctctcaggctagggaaatgtggcagaggttgggaaaatcaacttgtattttgcctgcatttgaaaatgctgggtaaattattttttttatttagatcagggtacctaatatttgatatacatcctccaatacattcattcgcttaaagagatgtacatatcaaaaatatgctggattatgagttttgtatttaaattggctttttggtagccttttggtgcatatcattaatcagttttctgatgatagataaaggtggaacgccaaactgattcgtgagtaccagaattagtatttttgctttttaagcatttatctggtgtatttcaattctgggtccttctatactgtcacttcccttcaccttcaaaagtttgcttaatgtctatgcataaattattctgtttgaaaagaaggggaggggaggggctttcatgtttatctgctagacaggacaatgctaatattttgtcccactggaatctattgattgggattgtgtctgactctttcttgacagttatggcaatggagtctcaagcagaggcccttaatcagttgacaactgatgacctagaaggaaaggtagcaaatatattattaatacaaatttagtctactttgtcatctggacaatatatctccaatctaaatcttgtttgtcttttgcagtttgcattgcttgaaagctcatcaatggatgatgatcttgtgaaaatgaaaagagaattgtcaggaagctctttggtatagtctactttggttaaatcatcaacaatattcatactttgtttattataatgcagaaaaactttattcaaatctttcatcagtgaagcatggtgttgatgttcaaaagcaattagatttgtgtgtgttccttttctatgcagtcctggaagtaagcatcaatatagttttcaacatttaggccttcattgtcttgtaagaaatgggtgcattttgactccactaagacccacatgtgcgcgtgcacacagagagaacacacaacacacacacacacacacccacacagagtatctagtttttaaagtgttacccttcctattcttagtgcttgttcacagaagtttcctcctggtgtttagaaacttagtaacaagaatcctccattaagagcagtgaacccttttccggaattactcagaattttctcctgcacccactttctaagtgttttcttactaaattttttcaagagacccacttcgccatacctggacccgcttctggtagctctgattcagaatgcttatccacaaataccatttatttgtttaggattatgtagcacactgtgtatttgccaacgccagctttttaatatttctacatttgtggttgatgcatatggcaaacatatgtttggtaaggaatgtggatactttaaataaaggttcacaatctcaatactgggccccttactggtactatcttggtacaatgttggtgccgggtgtggggtttggttcaacaaactgattctcgggatgcctactgtaccgatttggtgccaatatagtatgcaaatgaacaaaccgttacaacataccaagcttcaaatcacatgttgtgttcatattggctaaaatactctttagatatgcttccaatgcttgtgtcaagtatcctatttagtagaattaaaaaaacactcggtacttcctagactcacctgatattactctcctgatgctccaaagataaggagagctttttctctcttttctttcttcttttttctttccccagtgattaacctttcaatggtgaacggtcaattttggagtcagtaatttaacattaaaacatggagtgtggattggggtctatggatttgaatgctgattgaattataagcttataaaaagttgatgctattgtatggagaatggactatattattttagtagtctcattatttaagatgcttttttacatacatatatgtgcatatgtatgtcatatcagcttgtttgaatccctgtcatatctatggcccctgtccatgtgtatgcttcattgcatctgtctagattgtaaaccatattgttgcaagaatgcattcttccatgatcatgctatgattgtggtgatagtttaatcacatgctgccttcatgcattatgtcaaaaagttccatcagcatcatcgtgatcatgatcatcatcatgaaccgcaatatcattgagtaatctttcattgtgttacatctgtgatggtgggattttacggacaggataactgacagtttgaactatcatgtccaaaaattgctgattcagcctgtataccagcttgatgctgttacaccagttgcgtcttacccctccgtttttgcacatttgattatttaatctataaatacctgtggtgtcagtattagttcgatgtatagcactatcatctttaaatctggcagtaaaatttcaaccatgattttgaaaagtttacactgctcagattgcaaagtcatttttccatgtaatctttcagggaagttaatccagatctgttgtaaatgtttccattgaaattctaaagatgcagaacgttggaagaatctggtttctcatatatatcttattttctgtctacagagaggagaacttcctgctggtagaacggcagttagcagttcaaaggcaacatttcctttccaagacatggagattgagaatgagctcaatgaattgcgaagaaaagccaaggactattaaagcttccggcagctgttttgcaggaagtccgccttatcacttcatcttagtaaattcagacactttttatatagtaccagagcattttattatgatggttgaaaagaacaaatcggagtatctctgagattatgaatccatgctctattgagcggactattcttgacgcatcaaggatcgtgccttggtatgtattcagtagcagcatgtttgtaaaaaaaattagtcaaatatgatactcctttcttcttttcacctaattatacacatcaaatgtacttacacattatgcatggtggactttttggaaaatctgcctttgttattaactaggattttgtgcggtaagttttgcacctcaaggggctatttggatgatcctgtgcaatccaacaagatcataggaccacataccagtgacaggcatatgctcgttggaactcccgggtatagctttggagtgggcccccttttttttccttgaatttttcaccctgcagtaataggctagggtccaggcaaggtccagttaatatgggctgggctagatcgtatagtttgcaacactagaaatcatgtttccaattgcgaggatccaataggattattatctaatttggccctaagctgtaaaatactcttctactagtgctcaaagatctttgttaccttctctccccatcgttgcctttgatatcatggtcttgacttttgactacctcttccaaacatgtaaactaaatcaagcttatagtctcgttctctagcatatgaactggcaatcagcttcatctaagcgtttgtcaatttgtaagtgggaaatattatatgtggatggtatgagagtaatggaagttaaaatgttagattggttggtcaaagatcacatgggaagaattaggcgtactggtaaaagttaaggaccccgattttttatattattgactgcctatactgcgagtgctatatcaaacacaaatttcatgcaaaagatacgcctatccaaaccatcaactatcaataggttgcaggcatgaagatgatgagagcactaatcataaaaacacaaatttcaaacaatccattatatcgtatgatggcaaattgcatgatctttggccgaaacaaatttcctcaagatatagatatatatagacacacacacacacacacacacattcaaaaaggcaattcaattacaaaaagttttgaaaatcgaatgctccatgaccactgtttttgtatttgtgttaacctcatcggagcagcagccaccaaaaggagtctgtcaagccactacgacttcacatgatcaagagtgctaagaaattctaccaggatttgcacaaatttccttcatctgctttaggtccaatcatgttcccattatcaagatttctgacaatccctatcagcgcttctggaaacggaagtgtatttttttcgttgtgtgtgtgtgtgataaatatgatattataataaatatgaagaagcgtatcctgtcatttattatgttcacagattacatgtttagtacattaagaaagctgaaaaagtcatcaagaagatgcctaatgatgttaaaatgcgtgacattcaacctttcagactagactaaatctatgatttggctcatttcgtgtcaacttgtgattcttagatggtttgacaaattaggttattatgcttgcgtcacgaattagattactatgctctcttcattggttgtatcctcttcagaatgtgtagtagtgatgtcttagttgtctttttatgagagggaaaaaacctattttggtattgaacgaagaaaaagggagtaatctgtaacaattttcaaaaatttttaatttccctgtcaagaggttagctccggtctaggtccagagctgattgggatttgggaagtcaaaataatatgggaagtctctgcccaaagtccggaaaccaaccagctaaccattttgattgcatacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgataaaacttggcaaagctgctttaggttgagtctggccacagagaaataaaaatactaagaaataatattttgcccagcatttataatgaattgccaggcattagtttatatatatatattcttattcatggtagggttaggtaaagaattgctgctttgagaatcatgcttagaatggtcatttatgcatggacctgcaaacagatttgcttgcatatatcatacgccaaaatcatatgccatccagtaattctgccacagtaggaaccacttatttctctggttcactgcccagtcttcttcacatctattttttatcagcttctggtctctgggtctatgatgtagggcaaaatcagaaccattcatttgttgggttagcactcgggttgagttgttaatggcaaaggactgacaaacaagtcgtgttgctggattccagtacaataggagacctgcgttttttaaataagtctgccctctactactagatatcaaaacatttctcttttgcacatcccacaattcccgctacctctccaaatacattttaaaaagtgagaagcaaagaagatgcactcctgcaaagttaaaacacatttgccaatttgtataaatagtaaaaaaatataaaggatcatagtcatgcatacctcttgttaaatgcatgggacatgtcaaacgctagctgaaaatttgtctcaccaaaagcttccagagtagcacgcagtcaaggaacgccatcaataaattggaaaagtagctgcagcccaaaaacaaaacctttcagttagtcaaagctctctatatggtttgaacgatgacaaaatataattaaacatggcaatgggtatgagaagtaatatagatagctgtaattaccaagtatgatgcgcttgtggtccggatatgatcgtccaatgtacacagactgcttttctttgtgatgatcattcttatcattttggaaggcctactatttccctcctaaaagcaaaagaatgggatggaagggagaggggggttcaaatgaccaggcgtggcactccagtttagtattagaatgaagagaatgtcatccgacctccagtcgaaacttcatgctatgaactggttccaacacctgtctaccgaaacctgttcaaacttggttcttgagacaaactataagaggtgctgaggaatgtagccgctccctcccaccaccagcactggcttacttcctctcggtcattttctctctatccacaagaagatgaaatccactttaaaatggacttgtatatctatggttggatcatatttggatggtagtggttggatttaggggggtcatccgataaggttgcattgggttatagaagttagtgtatatcgaagtaaaaatattaggcacaagaaatgaaagtagtgtagaattgggatctccatggtcggacaagcagcatttgctcataacctacaaaaaataataacagaaatttgatgtaaaatagtaatgactttacatcaccaaaaaaaaaaagagagagagaaaagggatggtaacggcatagcatcctaccagagcactattccacattgtatgcaccaagaaattgggataaagacacaaaggacttatgtgctgaaaaatcctgtcagtgtatcagatttttttcagtccaactctaatcaaacaaggcaacatgcaattcttcagaaatgaaggtttagatctcacctctatcaaatattcacagtttacctcatgcccatgcaaaacagcaaacaagccaatattcacacagtttactccatgcccatgcaaaacagcaagaaaaaaggaataataatgagcatttctgagattttcatccagtaaaacatacagggatttcaaacaggtaaggtctgctgtccatcaaaactaacagaagaataagaagtgtctcaaagtgggggttttgcaagcttcggcttcttcggcaattcaggcttttttgatgatcctggcttctgtcggaccttggcagtccttttcttgtcccttctttccctcttcttcaatccattcatatgagctttagggaccactgcataagaatcttggaatttttggtgatccttcacagagagctaaatcatgcatttcaataaagcaaaagcacgtgatcaaccattacttgaatttaagatatacttttcctgtatgcattccaaattttaactatctaaaggaaaactacgaaatattaagactattgcaactatctgcaagtgaaacattaataaaagatgacagttttgaaagaaaaatttataaagaaatgtcaaatatacctagaaagaatttcagggaaaaaaatgctgacctgaacccactgcttctaacctaaagttcaagggggtcaagtcctgcaatctaatgaggccaatgaaatttatcctccgagcccactataccatatatcaccctgatatcaaagccagactgcagttaatggtactatgctcctgatcatgcaattgccagacagcatgatgatggcagactccaaaatcacaactgtagcaacaacaatcagcaagctatagaactgaagaattttttctttaaaaaaaaaaaaagccactcagatgggatctttcctttcaactacaaccaatacacttctggaacaccatataatacacaagaagatcatgtcttgcttctctaatcagcaagaacaatcaaaatatcgcagtatgttttcttccatgtcttccttgtctcctatatttgggaatgaaagatttgatttttctgacataccacagttcctcaaatgccttgcaaaagccgccagacacccatgctgtttgaatgttcaatgcaggggcaaagcctttaccaaatatcatcctagcagaaggttcactaggcttcacagaatctcatgaaacaactcaaggctgagaaagaagtaactaacttggtgacgagtacaatcaacactttataagcagatatcccaatcatatgagaattatcttttggcactgaccaaagtaaacagcaaatttgtattttcctagatataaaagataagaattatagtatcttacagttagagcaggaaacctaaaaaatcaatctccatatcctttatccatcttttcgaagagaaaagtggtctctattatataaaaaatctgagtgggacaaacatgttttagttgattggcctagaaaagtgaaacaaaagcaaaaagcattggtattttcccgttttgtcttattacatacaagtttgattcagttttcagatgtatacaactagaatccatccatatatcacaggaaaataactataaaatacaacttataattagattagacattactctcaacatcccatcatatcgacctaatgctgtagactaagcatgcatgcaaaagatacacgatagaagtttttttatccgatctccaacctaatccatgctcgaattttatcttttgaactggctagctcccaaaataaaaaattaattaaccattgatttggtcagataagtgcataataaaattaaatttgcttgatcaaacctcaatggaatttcttagacatataccaaataataatcaaatagtcatatacataatatgtatacaccctgacatgtttgctttgcttctagctaaccgaaaagtgacatgaatcatgccaattgaagttggtacaaatattcacaacaagaaggaaatatgctaataaggatttcaaaccatttttaaatcccccacactttcaacattgtagctgatgtgtttcttgttaatttccggcaaatatcacattaccattgcttaggctcgccttcaagattttaacgctcgtcttcctattctcaattaattactttccgaaaactaatacaacaaaatataaattctaaacatatggaaaattgagaagttaaagaaagtgaaatttttggatggttaaaaactatgtttagatcaatctcatctagcagacatattgaaggtaattataggcagtattttgaccttttaggtgaaaattattattttgatcttgacttctaaactttttatactatttctaatcatttttttgttcgaaagaatatcttaatgtttttgcaatcacctctatcacaaaaccaaactatagaaagcaaggctttgatctcacaatggtagtctgagaatcaaatcaaataacaaaaataaaaaagcaagaaaggagggaaggaaatgtgattactcacataacaaggtgccgactaggaggcagagttaagggctgcaaggaggtcttgcttattccagcctaagccaatgacacccaagctgttgggtttagaggacttaaccttgaggtcattagtttgtatgagtgttgagacatttcactatctatcatatgtctataatttaccgggtcgaatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttatatttttggagattctaaatcactgtaaattcattttcatcggcaacatcaaaaattggactcctattaatcattctttatgggagcagtgaagagattaatgaaagggaaaaggccttctctcctcttctatcaggtaacttcttttctaatttctagtaatgcaaattattttcgaaggatgctagacatcattctataaggatgaccaaagcagattgtatttgcttttaggagtactatagataagataagcattaattaacacaagcacagattgcagacacaaatgaatattgtttacaaaactggtgcattttatacttgtaaactgcagtaactttgatgttgcatccacttcatatatgtattgacatgtgtgtattagatgtcatattttaataattgtctaaatttcttcttttcttttaataattctctaactttcttcttttcttcagactttaaattttgtcagttttcaggtcttaatctgtacacaaagttggatgtttgactcaaatagatagaaaactgctttcatctaatcctgaaccaatgcactctatctcctgaaagaggttgcgtatgatctatatgaatttgagtgttgtgtcaagatctcaaccagaagcacacattctaaagtcagctaatgatgaaattgtgtccaagacagctttaggcaagagaggagcctgctaacaaacaaagctaccagagcatcagaaacctgcccttcaagctcatgcaatatcctgtcaatagtaatttttcatttcatcattcatttgctgagctatttttttcttatttctgtattcagaaaagtatcatcctcatcatattttggtcaatcaggtcaaaacaattgacacctgtaaaaattgccaagtatcaaaggtctgaaagagtctggcattccattctctaaactagcctaacaatgagacactgtgacacaataaagttatctagccataatcatattcatcaagcctcgtgccaattaatatagggtcaggtttatgcatcttatccacaagattaatattgagggctgctgcccctgatgttaagtcaagcttattcgtgccctttctcaaatctttcatccatggtaccaaaggccttcacctcctcttcctacattcttgagcaaaaacttgcctcttcttatagagcctcttcagatctttgttgcacatgtccatactctctaaaatgagtttccatcactttagccttaatttatgcagctcctgtgattcctctagaatagctcatttcttgcttgatgcatcttggttttaccaccacatccatctctacattcttatttctgctacattgaacttgttttgctggaccctttttattggccatctttctaaaccatacaacattagaagccctgtggccattctataaaatcttcagctaagtagccaaggcatacatcaatcacatgacaccccagaagtacatcttaagttcaaccaaccaggttatgttctattacttatcttcatctatcgcttcacatattcatataaatcatcacattcatctattacttaacttggggatttgtgaagtcatctgcatgtaacatcaaatttgcacataaaaacaaatttcacaagattctcataattcaactatacctactagcacaaactttaaaaacaagtttctgatgcccactactgatattcttcagaaggctcgataatagttagcaccatttagctgtaaaaagttagtccatactctgatatgatataatcacattctatcaggactattaatttttaagaaaccaatcagaagaaacaaaaaaggtggaggttattgtggagcatgaaaaactaaaaaatttctaaaaaaaaataaaagaatggtctgatcataaagaacctgcataagttgctttgtacaataaaatgaccatatagaagaagataaacaacagaaacaaatatgtaagcacatatatcccacaatctggtatcagaaaaagtattaagaaaagaggtgaaaatatgaggaagattgattagctgcaacctactgaagtggtgatggtttttctgccatcagtagcacgaacaaggcatctatattcctttgcttctccttcagtctccattttcttacgctttgccttgctttcatagatgctaatatatcagagaagcaaagacttagtagaggctgaaaaaaaaatacaaaacccatcgcaaatatatgaatgggaaaaaaaaactcacagcccttgagggtgacccagacagagcccttatctttgctccactcacgcatacttgtaacctcgttgagaatgggtctggctgtagatgaacctgaaatgggagaaaaaatatgggaagtgaagtatcacatagcatgtaacattgcaacaaaacacaccaaaatatatagacatatagagcaagttaaagaatccattaagagcaaaacaagaaggcaaagagaccacagatttcttgaaaaattgaagaatgaagaacataccaagtaaaagagtcgtataataactttgaacaaataattgggaaaaaggaaaaacaaagactcctctatgcatcagcagttcacaaataaacaacgaactgccagaggattcttgctaagtttgatgaaggtaactaaaactcacaaaacgttcatgcttcttgccaattaaaaaagggaaaaagaaaaaaagaaaaaggaaaaagaacatggggacaagaaaaagcaaagaacacgtagaaaaggatgtctaaataccagacaagacaatgaggtagagaaaataaacaccaataccacaataagatttaggtccgtagagaaacttaaaagaatctgcaaaaaaaggaaagaactaaaaccctccttgcgctccagtaattaactacaacaagtaatcaagaaagcatggtaccgtctcgaatcaagatggtcgacagatataccaaagaactccgaatcctcagagatgatatcaaacgaaaatagcaccaaagaacaaacattaaaagaaccacagaagaataacaaaaagaaggaaaaggaaaaaaaggtcgatactatacaaaagaactccaaatcccacacagatatcattctctcaaatgcaaatagcatcgaagaacatagaataacagaaccacagaataattccaaaatcagacacagattcttgcgatcaaagacagatcgcatcaagaacacgacaaagaacaagaaatcgagaattctttgaaggaatttggctagaaacgagctaagtggatcgtataagaagtggagaatctcaccatatcgaaggaattcgatcgatcggtcgatctgtcgcttgaacggaggaggaagaggagaggcggaccaaatcgctttccgtcccctttcctattctttctgagaccctgcagggactcggaggcctccggaggcttttaaaagaagtcgcgcggtatgctctctcggtggagttggacacgtgccgtaatgtgggacctgtgggtcctgccaaccatttgatgtctagatgcactccaaatttttccaagtggactccttttccactgtcaacgcaaaaaggaatataaactaactgggggtatatattgaaaatgggatgccaattacatcgtatcaagccggctcaccgcgtctccggatagctgttggggatagaaagggagaggctctcagtccaattgggaaaaattagggttctcggatatcgctgccaagtccttgaaagcaaacttatggcattaatggcgatgaccacgatcggcccaagagttccatttcaacgaattagagctcctcgggtagtttttccttttttgttcccgaaattttgattagaatgaggagtcatgtgctttctttttctcaaaaaacccccatgtttagcgctcattgtgttgtctgtgtttttcttggctaaaaaagattcttttttggtcttgcctgctcgtttcttatgttcatttcgcatatctgaatcaattgaagacaacttttctagaattatgacttacaagaagtaattttaaatgatagagaggccaattacttgtctcgattacgcttgctatttcaattgacaattgatttataaccgatcatcgaagagtgatgagttcttctgcttgtgtatgtcatctattacgatgactgttttagttttcaagtttttgatgtagttaagaagaagctcatttatatagatatgcaattctggatttcaggtgatggttttgatgcgtgcagaaacaagtgtttctttcaataaaactgtcgataatgttgctattggtaatgcatgggaaggtccgtaccagaggtaaattccagattttattcactattagttactgggtatttcttctttttccgtttcatttctcccatctaacttaaaatgctaatgagtctccgacttccctggttaatggaattgtaggtagagttggtgatttctagaggatttgcatcattttgttttttttgttggtagcaactacttttaatagataatgactagatcacccataccatagcctccattctgatttccttttattcagtttcctaacatccagatagagccttcatatcaactcttgttgcttctgtgtcatgtggctctcctccaattttgtccaattcttttacagaaatttccttggttgttgactgggattttctttttctttggcccctaaaatttttctgtttttctttaagttgggatgttgggagctattttatttaattctacaaaatgttctcattttgcgttttatgggtttatttggctgaatattgattgatggtgtttctaggttttaaacaatgtattatcattttatgaaattcctactgaggtttaaaataccggcaccaaatcccgcactatctttccatcaaaatggtacgtatcactgcggtacaagtatcgatggtacatgctgaaactgactgattctaaaaatttaaaaaatgatcaatactgactagtgcaacaagtatggtaccacaagtgcagattggtatgaagtggtatggctggtacatacttgtagtgccaacacccataccaaaatcagttttgcacttgaatggtaccatctcgttttgggtttttgaaaccatgtttgtgactttttaagctgcaaaagcattatgcaataacttgttattatgttaggagtaggcagtgtcaacatatacgcaagcatgtaaggtgaaatacctctgtaatttagcagcatttatgctgctagaagctgatgatatttgataaggtcatcctgtttcttttttcttttgttttcttttaacatataatttagatcataactaggaagaatttaatgagaaacaattctattaaacggaggagtggtacaatttgaggttaaagggatggagaattggttgagatggtatatcatgtgcaaagaaaatctagggaagccctaattagaaaggatgctaaatctaagtcgaagagtgtgggaggaaaagaagaaaagcttaattatctagtagaatttattaataaggatttagaaaattttgaagaaataccaaaggtatatcttgatagcaattattgaaaaaaaaggcatataaagccaacttcaaatattagcataaaaattgatgcttatggttataattttgatagaatacatatgattatatttgcaataattggaagatggtttgatgcttatcataaatggaacattttttggataatttgtactttgttccctcctgcttttttttaggatgaagaatgaaccttgcttactgtttttattgatgagaattttcttgctgatgtaatatagaggtagatcttctcaattccatatatgattggcatgatggccatgattggatggattggggcctatgaaacatcataaggcttgccacccacgtattgcattggatccattcaatcatggccgctatgccgagtatggacagctttatcagatgagtagacctctctagtccatgtcaatactagagaggaccctagttataatatatgcccaatcatgtctacccctctgccttgctgttcttagtagctagggtggtggttgaggtcgaggttggagctaggatccctaaggagggttgcccatcatatctttcctcagccttgccattctgagcatctccaatcgaggacagggccaggactagggccttcaaggagccccctacatttgccaaatacgttggtaccttacccttgatcttctttcccctgaactcctttatcttcttcaaggggttttttgaggcaagtgcattgtttgccgatcccttgcttttgaacttcgccgaatctgctatagccatcaattaggacattcatattcataaataaaccaaattaaataaggacctgactttgcacatatatttggtagggcatgatatgcgagagctgagaggtctatccgttgtttgatttggcttatttttggatgtgaatttccttagaagtggctatggcaaaaccaaagaagctcaagaataagggattggtagccattgctcctactttgatagcatcttagaagaagacataagaaattcaagagcaagatgatcaagtgcaaggctgtaaagaattcggcaaatttgggatcctccttgcaggccccaaccctagccttatccttaattgccaccctaattgctaagaatagcaaagcgtaggcagatacgaaaggacagatattactttttggaattatgtgggtccgattatgatagggcatatattgcattagactaggtgacacacctcttgtttttcttgtgtttctgagttggactttctatatcggacttgatcctggctttcttctaatttaaagtaaaagattcatgtactaatgagagggaagtaattcattattttatatacaaatgaatcttgactttttttcctttcggttgacatagagaatgatcataaaacttcttcttctcttctcatattttcctggtcctttttagatgactgaagaatccatttggtctgcttagaaagtgtcctcatgatcctaaacaccttctcaaagtcccaactattccttctttccttctacttaatgaacaagatgaatttgccttggatcttcccatccataaaaagaaaaaaaaacatatacagatccccaaatatatagattctttttcatttagtttctagcttgttagcccaggctgatgccttttatttcttttcccagattgtagagggtctgcccttcttcttatcaagaaatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgtggacacacacccacacacatacgcgcacacacatgcatatgcacacacttaggtttgaagttataaatctttataatattgctaggggttgttgttttatgaattctttgagcttataggcaaggtggaattgagaacaaagatattgctaggatggattatttttgtgagcttgtataggcattcttgttaggtgctgaactccttttcccagtatccattataattgttgctctcctgtctctcttccttttgctgtaattgaaaatatgcagtacccttctttccttccttgactataggaatagatggggctgtgaaaatgtcatttggatggaagtggtaataaagaaaaaaagaaggtcaaattttgcatccaattgaaattgatgatgccataagtatttatttcacctttccttctttaaattaggttctgaccatagaagatacatgaatttcatgatatagcagttatgttgcatttattctataacaaagaaattcatggatgacagaaaatggatgtgccatggctatgtcatggtaagcaattttacgactatgggcagtaaaatcaattgcttccttctcttccacttgtttctagatgcagttatgtgcatctgtacagtctccaactgaatgaagctattcctttattatttccaggttattattttcttgtggaagagactatatgtctttgtcctggcccacatttgcgactggttcaggtgaactcgacctccgactcaactctgtagacttcattctccactaatgcaggttattggctataaatgaatagtaatgtgatatactgtttggtatatcaaattaactataaataatttatggttttaggtttagaagcatcaattacagatcaaaagaagaatgacttgtcattggacaacgttaagatagttgtcgagtcacgtgatgatgataagattcatgtgagcctgtcacctgaactcttgatttcagtaggcatgctaatgttcaacaatattgcattttccaaagttgccctattcatttccagacaatatgtttccagcaactttcattactctaaatagcaatcttctcctcatgtgtaatattgaatgctcaatttgcattacaactttcttgaagtatattgtgcttccttgtttgatagcatcttgatattttgctttactcaatgccaagttgctactcaggatattgctatctgaaaaatcattatacaaaggagattagtggataatgcttacatggagtggcatgtcggtcaattcctgtaacttggggtgattgtttggaaacagtgaagtgcataagtcgtctacaaaggaagatgcaattcaaattgctcgacatatctgacttgacagagttatgttagaaagcatactgaagcctctattcataaaactccagttttgtgtagatagaagatacattcaagaggtggatatcaagtgtatctctaccattgctggaaaaaatatatataaaaaaataatatatatatatatatatatataagcggcctggttatctcttatagaaatcagatatcatttttttggatgaggttcttttttgttctttctgtctactatgacatagttcattatcctattatcaggtaagagtggacttgactggagaggagacacaaaaggcatttgacgatattttgacaaatttggcccgtactgcaccacctattccagggtttcgtagaacgaaaggaggtaagattttatttgtaaaaggtaatttttggtagatatgctgtggcaacttccaatttgctataagctcgtgatttttatttttttattcaatgtatttgatctttttctccaagcatctagagatgatatgatttctacatgtccaaatttgtcaaagtctgactcaagattttttccccctcaatgttcgcgggatgactcaaggaaaaacaaccaatgtaagtgaactctgactatcatgtgcagttatttgttaccctatttgtgcctttggcttttaaatactcctgtatttgaacttctagaacgtggtaacatcctttaatactgtttgttgtttatgagcataagtttttctacaattgggaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaaatcatcttctatagactggatcagaactcaaaagaaaaataaaaaaaatggagatgaaacttgttgtatcgatttttctcccaatgcttcttcgctgatattgaaaaaaaaaattcatttatttattttaactctttcaaaatatggaatatggtctgtaatttcgagaacaaagttcttgcaagtgtctataacaaataaaaatcctatccgaaaattgtccctctaaatttcatcaccccatttcgcaaatacttcagtgccaattttatgagtgagatgtccatctcatagaaactcaagttggcttttaggccaccaaatatgacattctttccattttttatctgggaatcctcttgtggtcaagttttggtgtcatgtaatcacaattctctggaatgactggatggtgaggggcattcttccttgataatgatgttaggctgtatgctatcaaactttgatggacaagcgtcatcctaaatagatgttcatatcctaatgttgaattacttgaattaatcactagctttccttcaattgtgtgccaaccatttttccagtaatttggctaatttttttcaaatatatagacttccacgtcttctttatcttccatgggatcttaaagatggttgggtggattacctctttgattctatgaagccccatcaagtgataacaataaaaatgaagtcagtgatagaagttatctgtgactagattgttgaatgatgatgattaagtttatgattgaggtgcatgtaccactgaatttttttttaaaaaaaatgatgcaggatgatgtggatcataatgtttgacatagtgtagcttaataatggcacatgaagtttcaccctttctgacagcctaactactggatttgtaaggatggtaccttggactacgtcacttagtccttcaagtcctcttaatatatatgaaaaagatgggtgttcctataaatacttaacactgaaggcacgacttgagagaatttattgtttgcatattatatacaatcttttaattacgtatgaagtttctaaaagaactgttatctttttctggtgttgtacctactagccatcatatcctataatgacttgtattcaagggtttaagaactgatcaaaaaaaatatatatatatatatatatatatattgattcgaaagttggcattatattttcttagaactctaaaatataataatttatattgatgataggatatttactacgattaacacgcacaaaatattttattttttaataaattattttttttgattatttttttttatttttcgagagaaagagaggagattatttctcttcttgtttcatggaatagagcatatggctctgaggaaagactgcttaatcttaaaattaggtgacagtgtcttttgatcggtgataaaaatgatgtttgtggttggcttacgataaaaattagtattatttatgatataatttatataatataattaaattttaattgagataagatcatattaaattattaattattaaatattttaattaaagatgtcatttgtgatggctagaaaggtgcatacttttctgttcctgaagtaatggtcgagaaagatgcctggacaaaagagagatcaaacaggccttgattgcagtacggcgtttttggtcaaaaatctagtatcctttttgacaatcaagttggagggtgtgtttttagactttcatcaagttgtatatggttattattttcccatgcaagtcattcttggggggcaacttggacgtcaaagggacatcgttgaatgaaagtaaagaggattgggggtatccttctggttcttctggtcatcattaatgtcctgagctatgaaatccaagcttatcaaaagtacatgctgcattgtgctttcatggagggttttaggattattttttttgacgtaagattttaggacctccttatgcttgattggatgatcttattggatcctcaaaattgaaaatagagtttataatgttatagagtataacatccggcctagcctataccaaccaaaccccttcctgtccattattttgcgatgggaaaaaaaaaatatatatatgaggtcatttttctttctatgagattcaaattggtttactctcaaaaaatttttaagaatgctacgaacataaatcctacctggccaatgtccttatgaattctattgaattgcattgaattattcaaatagaccatcaagttgttttgactattttcaatcttagaagatatctcccacacacgccacaccatatcagacgtgtatctttcgcaccaaagaatgattcatcttccttcatgcgaatccaccattggttcacccaccgcaatcctatgccccaagacttattccatggagaccttcttaatcactccccttaaatgatcagtcttaattgttgccttagtgcaagtggaactgtaattcatgtgatcaagcaagggacatttacttgcggaacaggatgctcttttccacaaccagtctcttctcttgccaatcacatggacagggtccctcctgcatcaactagaacaaaggtaacatcccttcaatttggctgccatgcaagaattaacttctcctgaaatcatggtttggagcttgatgaacatgatcaccaatagattaactcgaaaaaagagacctctaaataaatcatgtcaaattttgacgagcatatgaggaagactttcttatccatccatggcttatcccaatctcacatgcagggtaatgcatgtgaaacacttgtaatatcttagtcccaccaccttcggttttatctaccttgtcccctcctcttcttggcccaatgtcaactaattatttgagtattccgctttcccaagtttccaacctcccctgtatcttttttagttcatctcactcgctaattacgaggagaacctctaagattgatttgttccctctctcttgagtattggaaaatctcctcatcacacctctctctgtctctctctctcttttttccttcattctcaactaactcgagtactttttctcttcccaccttcctgaactaacttctctcgacttgtttattggccacccaacgtcttaattttgacttgttcccattagttaatgctaacttaaatgtcagaattttttaaaaaacatggccagcttgtattctttcttttttttttttttgtcaataattcctaatcatgttcattgggaccaagttgcccttctatatggagctttgaaagcctagttctcatatataattactgttgtattgtgattcgttgaaaccaatcaagtttgaattgaaagacttctatgtcaagattcctatttgaagtggtagaagaaacaataatagttcacctcaatttgataggcctgatcatggtccgtagtttggtcccaaattgtaccaaaaaccaaaccaagcttatggtcgcaagtaaattgaataaactcgaacatgtaaggacaactgacctaattgagtcccattagaacagataaaaaagttccattcatgtaaaacttagacctaacctagacttgacccaagggaggcccagcttggctcaacccacaggttcgggccggatccggctcaatatctggtccgagtcttgtccgagggaaccgatgaacaagacaggggaaacgtgtccggataacgaacggataacggaatccgatggcggacaagatatcatcaggcagggaggacagcgtgataaatgaaggataattgcgatatttcaacgccccgatgttgccagtactacccatcctcggcgtgtcggattagaaaaatgggtgggaatattggaattccaggttcagatgtgaacacctccgggtaaatatctgtccttgcgtccttgggattgacgaggcgaccaccgtatcccacccaataagagagggtaactattttccgttcccaaccccccaatcctctcaatctcaccaccctctgtaccccctttccttctaaatttaagcaagtcggtgtaataatgtggagtctcaactgcttcccccactctaacctggctggcttccaattaccccactccgtgcctcctatccttgatgccaatttacataactatcctttgaaatgcgtgctagtttctcatggttatttaattttatttatcaaaatatttaccacccggtcttctaatgaatatgatcctgggctagtaatgcaaccaagacaaatataacagctataaaattatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgataagataaaaaaagtttaataataaaatatgattattaggaaatccataatccgctcatgggcaaaattgtcagatcggcaggctgaaaaaaaaagggtagttggggggcattttagtagtttcgcgcccaggctggtcctcttctcttttattcctctcgtttctaaacctccccatcccctgccattttcctctgttcctccgtccgaaacagagcacggcaacagcagacacccggaagagggagaaagatggttggagatttcatggtgtgcatggacaggatcatctcctctgcttgcttagaggctggtaatggcggtggtgggtacggtgctccaacggtcgatgttggtcggggcgaggaggggtcttccgagaagaaggctcagtctaagaagaagaagaagggtggagatgttatagagtgcaggatatgccaagaagaaggggaggagagcgagatggaagccccttgcgcttgtaatggcaccctcaaggtctccctatctcttcttccctccttactgccttcaattgcgctcttgttatcgcaaaaaaaaaaaagaaaaaagggaaaaaatttttcctagacttttttttaaatacaagtttcttcattttttttataaaaaaaaaagaaattgtggtagaaataagggaatgtctgcactacaagacgcacgttggtcttaatttttatctgcttcgaatggactgtttttgtgaatatttgcaaaaaatatatatttttaaatttatgatagtagtacattttcgctcttgggatatacaccatctcccttattttttatctggtgtagcaacgtgaaatttctgttttctttggattttttctgtgggatctgcattttttttgtgcgaatcctgcctgtgttttgtgtaaaaatggaatttttcttcccgattctgaatacattcttatgttttttgggtgcttatgatttataacaccaaagaatgtataatgtttcgggtgattgtattgcatgtcagtgtttccattttctctgtcacattggatgcttcctttcagttcttgtactaaaccttctcaaagtaatttatttggtgggttgtttttggcgtgtgtctgctgtaagttcgtttgcgttgtcccaaaaacataccgttaatgtttttctgtttttgtctttgtgagctgtttaaaatctgtctcatatcgggtagtcaattgtggttaattctttgaagtgtgtttaaaatgcttactgagatttgcataattttttgcattatggttttacgtttttgtgattcttgtaaatatagctgctttttcttttttggccattcatcctcctccagtttcattagttattactgttgcgttagttttccttgttggtcttttcttggctgttagagacctgattttatacccaaaattgttttatttggatgccagctatggtggattgctgtgactgattcttttggttccgcactttgtgaattgggattttgacaaacatttcaagttgtttcattcatttccttggtgtttttaagcaccaagggtacctgtacatctcttcctgattattcctttttaatgttgtgagatgcattttggggaaaatgtaaatgaacatgagctgtatattagagtttgttccaaagtgacattcggtgtgatcatctaaggacaaaggacagatagaacacacaaaaaggacttgaagttgcttaggggaggctcatatttgatgacaattattggcaacatataaaggaaattccaacattggaatttgagaaataatttgaaactaaatttgcattagctgggaaagtaaccagctgcggggaaaactagtgaaagtttttatgagccaatgactaaaaacatgcttgaatgttagttgttttcgatggttggtttttgaaattgaggatacatttggttttcagctggattttgtattaggggtgttatgatcttatatcaaagcctgatgacaaaattgactcaactcttgctgtatgttgttaggaattactgtttgcttaagccaaaagaattggcctttttgtagagttgtagataaggaaaatgccaaatggttaaagtaaaaaccataattcttccatatttatatgtagaatacttaggaccaataccattaactaaggaaaatgataatgatatttaatattgatgtggctattttacataggcgtggatgcaaaaattgattttggctgcattttaagtgttagattcttctacttcaaggatttcttcttgcattcatgttggatcatggcaacacacaagtaatctgggatgaactttacaggggttatcactttttgaaattgatttatcatctcataccttctctgagaattagtgatatagcttgtattggtgctgaattcactatcatatttctgcatgtataaatatttttatattgcaaatcactggtgttgcatttggggtttaaagttatggtgttatattttctaatttttttcttgagactagtaaaaatcctttatatgcataaatctatttattttgtggccatctttttctacaacttttttgatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacagagcattggctgttgatgtagccatgctgcgttaaagtttataggaacttttttgtttgtgaaattgttatcgtagtgagtgctttaattttctttgtagattgttatccattttttgacatcatatcgtttgtagtaatttgtgcattggctttatgtgccatttagtacctccaacaaaagtaagataggacccactaagttaagtatttcttattgaactgattctgctatactaattttttgatttcttaagttttgtttatagtggttgatcaacataatttatcttgttataagacaagaacatatattacagtttaaaaactatcgtaaaattttgattagctcttgtatcaatagagttcttacaaaagaatttttttttatttcttcaatttaacaggtttactcgcccgattattccctgcccccaaaaagagcttgttctgatgcaatggccattgatatcaggtattactgtatgacacctggttgtgttttcttgtttcccctgatcttcattcatcatttcactagaaaggtgtcttacgtatcgttcaactattacaactgtaacattcatgcttttctttttttttttctttcttattatgttcagtttcatgtatgctagtttgtttttgcagcctttgttggctaagcccacttaattctttccattttttcctttctctgtcatgagtgtggattctctgacttgaagagttactgatcatcctttgtttttatttttattttcagtgattttaaaattaaaagttcaaatggttttctgggatttactgttttaagatccatatggcatcctcccattactttatcgattattttatatgaaatcctgtggatatttgagttttgtcatagctactagggagctcctcacagggagaaatgaaagcattttacaggaattttgaagccattccagatctacactcataaatatctgttactttctaaaaagtacatgtaggtatcatgtgttcacaattttacgtcaatgaacttaatatcaaattaggggaataagaaaccatgttttgcttattaattttttgatattacttgtgaccttttactttctaatgcaggcaacctatagacgctagttgatctctatgaatatttgaattgaaactagttttaagatgtttttggctatgtatttgagatttgttcctttatgcttgttatgtatttgtagatactacatgtcatgtcctttgtcatgaagacctctgaacgtgtaatgtctcatgattccttttaggttaagttgtcattttatattttattcttgaaaactatggtttttgttgaattaatttgccatatagcagtcaagtaagaaattctgaaagttgatttagagatattggttttatgatatctgtaacctatgcattttgatctctctctctttctctctctcgtgcgtgcatgcatacatgtgcatgtttgacaatgtcaatgtcctattatgagcctgacttgaagatggcattgttcagcatatatctagggtttaattaaattttacttttgttaattctcttttctttttcattggaaaaagatcctttgtctactcattgtttcttcccaaactttattccagatcaagtttattctcttaaccatactgctattttattgttttcatgtctcttttaattaactttatgttttttagtcgtcttagatgtatctaatagattgaggtaatatgatgagagaagggatgaagggcttcatttcaggtcaaatccagcatgatctgaccaattccaatccatatttttagagacatgaggccgcctctcgacatgtgcattttactaggcatatgcttatttttcatgcaaaaagggcatcttaccaggcatatgcttatttttcacataaaaggggaagttcaaggcttcctatcttgctgagccaagggtttcctccttgagtttccataactcgattaaaaattataaacctcccacgcttcggttttgcattgaatgccagtgttaaaagttggacctaaatgtaaaatttagattctattgttaatgcttagtttttgcttggttatattttgcttggacttggaggttatatttttaacttatcaggtttcaggatatattttttgttttagtatccttaatgttttcatagtgaaagaatttagtcagatcatgctcttggaaaccttcaacttattcctttacaattgaaaattaccaggttcaagcctatttcagcataagctactaatagttctggcttcaatatttttatttacccttctatataaattgtttgtcttgattttgtttaatatatgatcctaaccttcttttctttccattgtcttgttagacaaagttggggcacacggattgatcttcatgattcccattttctagccattgctgctgcagagcaagagttgctacgtgtggaatatgaagattatgcagctgcaaataccagtggcattgcctgttgccgctctgttgcgctcattgtatgttctattggggttgggactttcttttgattttaatttgcttagcactatagaggcctgaagtctgtgatgttatacagttgatgctactgttgcttgttcgtcatattcacatggtcacaagggatgttggaatggtgcaggatgtatcagccttcttcaacgtaagatacatcttttggtgctttgaaagtttagagtatgcaaatattttaatatgttccatcaagttgtgtacgtacagttttgaactatgaggcaaatagctaaagttgtagtcagcgtttgccataccgtgcctaactggccggtacactccgtatcgtattggaccggcggagaaccggcacgattcggtcggtaaatttggtacaccggcggtatggaagaaaaaaagagaaaaagtgagaaaaagagagagagaggaggagagggagggaggtgggagccgctggagaccggcggtgtccggctgcagctgccggagggctttcgagccccgtatcgcccgatagggctttcaggagagtgagaaagagagagagagagcgctcaggggggaggaacctatcggactcgcgaggccttcggtggccgacgccgacggcttgagggcggtggtgcgggcggagccgcagggacttatcggacggacggtgcctccgtcgcgaggcctccggtggccggcgagccgacgccgacagcctgagggcggtggtgcgggcagagccctctgcggctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcctgttctttgatatacaatgtgtgtaatcctcatcgatacttttgttcttctacacttgcaaactttgtttgacgaaatcggttgctaagcagaaaaaaaaatatgcagaccataagcattcttgtgagttacaagaaattttgggcgcaatgtcctaataaacaaaaatccttcaggctgtcgcattgatgaccacacaacagtactatcagcaatcagatccaacatactccacatcctagagctgactaactgcagataacaagaggtttgcatataagtagaacaaaggataaaaatgaaggcttgtgtacattgatttttaaaaaaagaaaaattgttttttccaagttccaatgtatgaatgatcttcgaagtctacataatcaatcaaaacaaaattccagcattcaacgagaattccaataataggacccccacttactaattggattataatatcacctcactgatccttaaaatcccgacactgaaaatgaccgagcttaacacaaaaacacctcccattcaattccacaatcgaattataaaaaaaatgcatgaaaccctagaatttcagcggatctgacaattctacaccaagactgcatttcgatgataaattcaacaagccaagaagctcgctgcaccgagttcgaaacaagaaagagagaggaagaggagtaaggatcggggagatcgataccttcgtccttgacgtactcggcgaaggtaccgcaatcggagcacagggcgagaccggtgaaccctaggttctcgcactccttcgcactgagccgctcgccgaccgccagcgcaggaccagataggaagaagaataggagagataggagggcggcggattggcccatctctctggagggtttctcgggaatgagcccagagacgaagtaaaagacgaacgccagaaactgtccttgggggtctatgacgaagaacggagactggggcacggcaattatcgctgtttgtattttagaaacgatggttggtaattatgcgttagcttggttgaatctcgtatatgacttcagagagagccagggttgtttggtactgttttcttaaaaaaataaaaaaataaaatttaatatagaaaatatatttacttactattttttatttttattttaaaaatattttttattatttaaaaaataaaataaaaatattattttttatttttaatgaattttcatctctctccttctaactccccttctttcattcgatcttatctttagcccctatccagccacatccattttttagggctcgtcgatcatcttttcatctaatatcaaataatctttcattcaaactaaattatcaattccatccttatttttttttctcgatcgctctctaatttagaatttttttttatgtcaaattttttttaatttttgaccatgttaccatcccattccttctctcatggttatcgctgatcactttatcaacccacaatgtgaaaaaaataaaaatataatgtataaaaaaaaataacatgaagtacaattatttctattcttctctccgactacgtttttaagaaaactataagttacttagaaaactctcaaaatatttgtggctactttcaagtctatttggatagagggggactcctccgttgttattcattaattgattggcttgttttaatgtcttgatatgggtatgtacatgttgaacacctagctatctcggatggtctgttgttatggcatgtaataaaattattttatcttaattataataaaaaattaaaatgttttatgatgcatattttgaaccgtagatgataatatataactggatgaacgatatgttatctatcttagaggtacacaggttttcttatctcccaacgtaatatctttgatacactagtcatatttggcatgcaagtgtaagggccaatgatccaaggattccggttgtatcctacgcgcgaaagggtgatttcttttgcaacattaatcgttgggttgcacttttaactaattttaaaatacgatgagatagatcataaagttaatattaccttttaaatattatgtaaaatacgacccaattgttgatattgtaaaagaaatataaatcattcctacgttccaaaagatgcagtgcaaacccatggtcaagatgggtgatggaccgccgatccaaatatatatcggatctaaataaaattaaaaaaaaaaaaggaaaaaaaaagggtttgggacgctcttctcgtcccaccgcgagcgtttcagcattgagagccactccgacagcaacgaggctatcccctggagctcgattgctcgtttcccctgtggatccctcgccaatggagctggaggactgcgagcggatgatgatggtgatggactcgtgcttgtcttgcatcaattggcgtctgcaatataggtcgaagcgtcggctcttgacaggtcgtctccttccttcttgcccttcttttcttcgttgttttggatctcctttcttgttaatatctctgatttatggtctttgattctgaatgtgatccactccttgaggaatagttcatttgggtgtttgttttttattggtgttttgttgattttgattccgttctgtgggtttttgggtggatttgggattcgagtcaagatggtatcttttgaacaaggtgttggcttaattcttttttctcaaccttcctttttagtatttcttgaattttctacttgattatgtatgcttctgggttatgattagagaaatgttcgtaacaaaataagtatcaatctgtcgaattccaccttcttccttgtacagaaagttttctttctcggttgctttcttatctttagtggttatatgcttctgggcgtgggcctggtgcaaactttctgcaaggacgttttccattccgatacttgatttttgctgcaaatttatagttactctgagacttgctgcaactatacgtgtgtttcttgtgtgatcaatacttggagcatcttgggaatgaaattagatcgtcttctaattaatgcgttggtaacttttgtttggtctgatcttcttttcttttttttcttttggatacgagggaggttaaaaccactcgaaagtttgattggttcgttgtaaatgttgggtacagtaaatgccccttttctttgatgatgtttaattgggactttgtattaatatatttttacgcttcttctgcttctttcccctctttgttcacgagaatatatgctactcagtcggattcaaacatctaaaagactgtcatttgtgtgtataattttcttatcatattgatttacttccaaactatagttcttgatagctttcctttatggggcattaccaaataagatggatctaggccttctggacaatatctcatgaactgatagcaatctttgtagcaatatgttgaaccacttaattttcgttttgcatgagacaactctagatttcctgtcttgttaattaacaagcaaatattttctttaagtttatctcggttatgtgtttgcatagaaagcaatacatgctattttcaatgtgatccaaccatttagaaaccatttggacagggcacttatgttccttttcattgaatctaatatgatttattagtacggggtaatttctaaacagcaggatatgctggggcattacacattcataactttcccatttattgcaaatctgtaacaactgactgcgaagatttttttttttttttacagacatactttgtttatgcactggactaagaccagtagttctggtggattatggtggactgatgccaaaactccaagaggacctctgcttactacttcgccttgcccaggaggttttcaccttggatagtcttcatctcaaactcagtaattttaatcttataaaatgttcatgcaaattatctactactgtctttatactgttctttttttttttctggttgatgctttccgtctttatctactacaatgattatggtgaaagactatatgagtattttatgctattgtcttatggaaatctcataggctttttagtgaagttgtattagatagtgaggaattcctttagttcaaatgatttggtatcttaaattgaaaaaggttaaaaatagtatgaacacaagaaatgccctcctgtagatttatggaagacaaaaagaaacatgtagattttttccttaaagcgtagatatcatgtaaatttggctttctttttttttttcctttttttttgtgagaaaagataaagtttcacctagttttcatgcaaaaacttgattgaggtgcactaataattaaaatcatgtcaagtaagctgatggattttcaattcttgggcttagaatagtgacaatgtcataactactcaaatattgctgaatagggatttttttttttttgtgaactgaatgagaaccttttaaggcttgcgtgtaacacacacgcacactaaatgagtagttacaattcaggatatggttttgatcaaactaaatgagtctggatttctggaatttcaatagtttcagctgcacattcagcaatttcatggttcaaatcaagggaaagtaaaagaaaaaaaatctcattgaaataagaggatatcttctataaatttgttattttttatttaatttacttgttttaatctaatcattcatttgtttacgggtaaaaccagaaaattgaatgtctatgggttcaaccagttaatcttagtgagtaagagagaaaggacaggatggagagagagagagagagagagagagagagagagagagagagaggagtagtaggtaggtaggtaggtagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagaggcaggaaggatagtggtagagttggagggagagaaagatagagatagagagggtgagatagataatcagggaaaatgataaatgaagagagaacaagattgggggctgagggtgagagagtatgagttggaaacagagcaagggaaagagagagtgagagagtacgagatagaggtattatgagaaagagtgagcaagagaaagaaggaaaaagagcaaaatcccacaaatatggacttcttgagttagaaaaactcctgaatttgtgaagatttgagtacttagcaacttttaattggttacctctgaggtataataggtttcccccaggctggatatttgcatcaaaaagatgatgatttagggggaaaaaacaacatagaaagcaaaacttataaaataaaatagacattatttaaatagcatattatattatttgacatttagatgagttgtttcagtagttttgcaccaaaagaattaagaattaatgatctgttagagtattgtatttaaaagaaaaggcagtatatcattttaccatttgatgttcatcatcttatgatgatttaaatgcttgtcaggatatagttatatgttgaccagataaacatctggaaattcactttatatggccaaatatgcatctaagattttacttatataactttttttgccgcctaatattgcaacccttgcaatttttatcaaaaaaaaaaatcataaaaatctatgtttaatctaaagaaagtttttcctgtcatttataatgtacataactctatttacactatctgacccatgtagaattgtatccagcctacactccaaaattggttttggaaacagtagaaacttaaacatttaagtgccatttttggacttccaggagaaactccatgtatacaaggagagcactctggagaatgcttaacatgattgcaacttttgggctggttggtgataagctctgatttagtcttttattatacagagctaagatagaccaagtgctctattggagagggtagtgatggtccaagaaatctggtggcagcagcagtgcttatgtgctaaagactaaggtcttaaatctcatgggacagaggtgtcccggttttcctatagaatgggacgccccactgtctagtcttgtctcgattgcagtcctgatcatgcgatctaatagatatcctccatctctctcccctaattctttttttctttctttttcttctaccttcctttattttttctttctttccttacccctttctcttttttttcttttcttctttttcctctctttttcttcttctttttctctctttctttcatttttcttctttttctttcctttcactttttgcttttcttcttcttttcttttctctttcttcttctctccttgtgtagatgggtttcggagtcccaaccttgtcccagtcccgttttctcataggaacggatgggacggccgggacaccccctgtcccgctgggacataaaattttgctaaagaccacttggtccacttttggtagcatagtattaagataccggtatttgttttagtttagagaagccttgctgttattcttcgttattcctaaaggaaagaggtgacaaaaaactaggtaatacttatccatgagatagagtagatgttagaatttcagatgaaagaaaaagagaaatgtgtgcttttgtttgtgcactttctattgcgatgtgcgggtgggctgatgggatgcagagttgtattgcaggagaagataaaaatgtgaagattgtttctgactgaaatataagtagaatccttgtgaaaaaatccattgtaattttattgattttatgattcttatgcatgcctaaataccatataaagaaattgattttagttgttccaattagataactgcaaggatgtcatacacagaattaagcttagcaggcaaagaaataataaactaaacatttttttgttaaagctaagtaacatccatgctagaagatagttccccatttcagcattatacttgtgtcaatatttgttggtacaactttgtttcgtaattgaggtattttgtgttgagtgttgccttttctaattgtttgagccagcctcccttggttaaggattcccatggttggtatttgctaattgccataattctagttctttcaatctgaccttgtgatggatttgtcaatatttaatctttgtttcttacttctatgcatcgttctccgaaccatcctgaaccgtaccgatggaaaaccagtctggttccaacatacaaaacagcataggccgtctcagagggagcgagaagaaagagaggaagagagagtgggggagagaaggagagggagaggaagagagggcctcctgttgctgacttcaaccaaaattataaaaataaaataaaaaaatagcgaagtcggcaatccagttgctgacttcgcacgataaaagcaaaaaaaatacaaaataagattgaatccctgtttcgcacgagaggagggtagaggccctccttcagccttgaccgccctcaggtccttcggtggcctccagcgcctctcttcctctccctctccttctctcccccgtctctctcttcctctctttcttctctctcttctcttctctgtcttattgattcggcccagcacagaacgttacaaatctgtaccgaaccataccatcagccgaccagcacgagctccgattccggttccgatttagtggtccttgcttttatggcttctatttgtgagatttaagtacttagtaaaactttatatctaatttcttcaagaccttatcttatttcatgatgcaattcttctagcttgttaatgactcattaagaatatttgtctttcaaccttgttagagtcaagactccacatctttgtccggttatctgaatgaagtaattgctctttatgcatggagtagtgtttatttatttatttttttccctgggaagtgcatggagttgtctaatagtacgtcttatcagcagaactgtgatatataattaaaatattaaggatacagagtaaccgaactggctctaaatctaacatagtacttaccaacaatagtgctccttttgactaattaattctcactattcagaactttcttttgatacttctgcctattttcggttttcagtttacctaactttatggatctgcatacactaaaattatggcacaacatggttacttgcacagaagtcagccattttacagccattgagagtgattgtcctagaagatatggcttatatagttcatgtcaaagaatttgctgagcatatatcgtcaagccttgcctcacagcagcagctagttcttctagaccttgaacgaagccctccagaggtgtttcttactttcctgttgctttcctttcgtcttatttcctttttgcttactcttatcatttgctacagttactgttgcatgcagtggagaacgaaaatgcatcagaacttcgtcaagtccaaaaatcattttcatcagtgtttcctgttgaagttgacgcaggtgttctacctattgtacctggtcccatggtaaagccagtgattggatcatcaaaacgtgaggctgctgatctggcttgtagtagcaagcatactgcttttcaaacatctttggcactggatctgagttatattacagaagatgccaagatcactctatcatctgtgaatgggtaatctcccctcccaatgaggcgcctttactagtttttttatgtatgtcagtgcagaaagacatgcagttgtgcgttttcacgtacagattcttttcaacaaattaaagtttgcttaatgcataatggacattggataataatatttttgccactatatgtttccattctattaacttgatctgacaggtaatttgtcttttcctctcagaggaggaattgtgtcatcaacacataacaaaaataaaatctttataccatgcagttattaatatgatgaatgattttgcgttctgagatacatcgattagtggattttgaggaccatattttgttgcttttctttgtaaacatggtgacatgcattattttatataaaagaacaatgagaaaggagattttatgattctatgtaattacttttaagtttttgcaagacattattcggaagatcaatatattacagtaggtgatttttaactctttcctgtggcggcttagaagaaacaagttccagaaacccgtcatactcttaaataggccgccttctcaggagtctaaattgaagcctcttaaacaaacacatttccatgcgtgcgaaaaagatagaccaccataccttgatattaacagttaaatatccctgttgaatatgtgttgcatttataataccaattccttgggagctgttgttgtcaagtaaaactggcatctacttgaagcttagttacctttgaaaaaggtaccacttaagtaggtttctgcacctctctctctctctctctctcgtctcacattactcccggacatattgatttgtctcacctcatgtatgacaacatctttcttgagtctttcaggtgcctttgtgcctcttttgtctgtagtacttattttcatcttgtgctaaatcactgaatcttacatggctcatgtaataatgcagacattctgaaacttcagcatctcttcctaatctgttcttacatagatgtgcttaatactgaataacatatttgttattgcaggtggcttcttggttatccaataacatatttgttcagcaaagagcatggcgaaaaagctatgcgtaatctctctttcaagtctatttatcactacaagctttttgccagcaggttttgacacttcctcctgttgttaagatcacttgtttcttttctcacacagactagtgatgaaagcattctattaatgtacatacagaaagggaacacttagcccaaagctccaggaggatgaagtactaaggttcgttgtcttgtttatattgcgtaagatttgcatacatatatgttccttgttttcactgttcaacttttcgtgcattgcttgaacaagcatgcaccaaagcccaaaacagtgccatcattacctacattaacatgatgtgaggcttctttctattatgaccgaaagtggaggagcagctttaggaatgcatgcccaacagggcatgatgtcaaaaatatattggttatgatggattcacaacctatgttcatgacatcggagtaggggattgaacgtatggtacccacgaacatgctcatatgaaagccatttcacaagtaatggggataaatataacaatatttatgcctgccgcacaatagacatctatatgttaaacctaatcgatgaagtattgtctgcttcatagcttaaatgaatctaaaaagtgattcatttgcttagtatgcaaaatggcatatatatatatatagctttcatctaacgagtatttttatgcttgcggcaaaatggttgaacctagttttacagtgccttgtgatgtggctaagagaagggaggaggagccgtggattgaggcatttcttgctcgcatggagggaaagctaaaaaggtgcaaccaggtgtggatatcgatgcggttggaggtcaaatttttggaaagcaattcacaggtcatcgtcgtgtagccacaaatcacatgacatcttggagcgccaaaagaacaaaataagcttccaatagaaaaatcagagccaacagaaaaaatgaagaaaaaaaaccttcttaatgctcttaaattcaaatcaaattacagcatggttgtaaaaaaagggaacatatggaaccagcaataatcttatgatgctttatgctctttccagcagctgcacgacttctgattcatttggcaaagaagggattgctcctttcttggtagtggtgattgctccacacgcattggcaaatctcagtacttccctcaatttcttctcatcctgcaattcatcacatatgattctatgagaaacatgtagtagttggtagattaagataataagtctcgcagctcgaaatcttttctaagtttagttgatacaaaatcataatgctggtcatttaactcacctgcaaagctgattggtcttccacgatctttcggagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggtgtcgggcaattgagacccgatccaaacttttctgtcgggattttctcctatcgggatcgcctcgagctgctcggccggcgaaccccgctcttcctcctcccgttgatccagtttgtcgattgtcaggggatcctttgtctcgtcgctttggacggagatttggaagcatcgtcggacgagctgttgatctccgcgcatctccccgactccgtttttggtcgggaatcgaacaaggagatggtacgtcgagacgatcgccctgagggcgttcaatccgggtcgcccgagtatggcgttgtaggccgaaggaacttggacgaccgcgaaaatgagggagactgtgctttgtcgtggttcggtaccgaccgtcacgggcagggtgatttctccttctgtcgtgacggtgtctccggcaaagccgatcaagggcgtggagaccctactaagtcgatcagtcggtagccgcattcgggagaagatcgagtaaaacaaaatatttgtcgaacttccgttatcaacaaaaattcgttttacatcataattggctattgtcgccgacacaacaacagcgtcgtcgtggggagtctggatgccccgaatgtcgtcttctgagaaggtaatcacgtcgtccgggcgcggctttttcgtcggctccccccctgtagacgtccccgatcccagtcgcttggagatcatgttgatgactcccgccgtcggctggttagtcggcgcctcttcagtcggctgggggcatcgatcggcagccgatcgggtcggcggaccttttcgaaatttgccgagatacccccggcggatgagattttcgatctcgtccttcaactggatgcatcgctcggtgtcgtggccgtggctccgatggaaccggcagtacttccgatggtcgaggccctttgccttcagagacggaggccgtcgcaggtattcttccccttcgatctccatcaagatctgcgcacggggagcggagagaggagtgtaggagtcatacctgggacgcaccggcctcggagtttgtcggcggggtgatttttggatctgtcggggtggagaaagccgactattggccggaggcctgcttggttcggcgggctcccgaccttttcttcgcttctccttcagacccctgggctcgaccaagcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcttttttcaaataaatctgggtttgaagcatccagagctggtcttcgtcctaccaaacttggatcgtggtcaggctaattgattcgcatcaatgcttgcttttagcaaagttgtagctgagtttctaccaaggcaagcaaaaagctccgggctggcacaattctattaaaaataggtaggccaaaatatttgttgctgcggtatgttaggtgggaacactgcctcccacaaaccccatttcaattaatatttctaatagctatttatttttctagcataacttgtctagcgacttttccttttaagagatcactgcagacagcctttgacgatagtcccatactcattccacagacaaatgaaccgagaatgtacctttccattttccaatacactcttttcctcatcaatctctctatttattgtatgtcatacctacaaatttgtgtgccactgttatcattttaaatgtatactatcttactacgtccattttcaatctgttaagagtccgctgtcaccatggttaatagctctctctaaagctcagacaaataatttgaaaatatttgttccaaggttactcctacggatgatagcattggtctaaaaggttccaaattgttgttataattctttccgttttttgacttggcaagttgtgtacatgataagataagtatccatccagaaatgaaagtttatattagatatatgttatcgttcttatccaatatgacagtagtcaaggctatcaagccatgtcataagtccatagaattacaatcatttatccagtgttcacgttaattagtttagttatttacatcttgcatgtcggatactattattgtcatgcatagagagatcactgatcccagaaagggttggatacttggattcttcttttattaagggacatgtccggatccatgcccctgctgccatcgaggagataatatagaaggtcggcgtcatcaagtcgtattcgggaaccgcgatcctttggaaacttggggaaactctccacgaacgcacgcgtgacaaaggatgagggccagggcttgcggtgataattatattggatgccataagaagacgagccatgtcacgtgctgagagggttctgcacgtgagtacacccggatctccggatagatttcccgattcctccctggcaatcggccacgtgggaaaagacaagtgggtgcgaagagtccgtccaatccaaatggctgagctgtctttgaccgtcaccacgcctgtcacacccgcagaattggaccaaagggagggagaaatgctttggaataattggaagcatgagtttgagacggaaaagagagagcttgatgggccattaacccggaagaaaaagacctacccatgatggaaaagagttgatatggttttgttacagcagatactcggtttggatggaaattgctggagtgaggcgatgtatgatagaggtaatggcaaccgaacttactacataagtcgtcgataaaaaatagttttgatggagacctttcagtattcaaatcaaaaatctgaaacaggtgaaaaaggatgtacgaaaaaattatatatcttgggaggtcatttgttatctctatttacagaggcaagagcaatggaagaggagaattagagactactccgatttttttgaaagtactatcccaagatcttcaatctgatttcttgatattgagtgatagtagctattttatctgatttaatgaccagttcttagtaatggcatgatttgatggaattgtattagaatttttcgtcaatatttttgaaaacaacaattaaagtggaggttggaagggagaggtcgaaaaaatatggcccaatgacttaccacgtatattgttggagatagggattggtgtggatatacagatcggagccgacatggggtcagagcctgaaacttggattgggtccgatgcccagagaacgttctgatatcgagagcaacgatcaacgtatagatcagtggtctgaaatgcatggagattgggatcggcagtaaatgagagggttgaaactcgaagttcgatcgcaggtcattttgtcgataagagagatggttgatgtgaaggttagcaaattgatgcgtgcagagatgagagtcggccattgatagagaagtcagcagccaaaatatggattgttggatcatgcatgggcatggtgataatgaagtcaaaaaattatgtttaggtcggcggctgatacgaggattaatgatcgatgtatggatcgattatgactggagttcagagttccatccttaacaagctccatataagcttatgatattgttcgtatgcattcccaagaggaggcatatggcccaatgcaaagagagatcgaattccatgactgatatgtatgggagaaagggtccaggcaacatggaaaagttctggctggtgtaacaggcacaaccctggccaactcattaacattttatatcatgaaactactgtggtacttgaaaacagagcttgacagtgttgggttgatggttgaagcggcttgatcgttggttactgtaccagaaggagagcctttgtgacaaatgaggccaatgagcttgagaacttcaactcaactatataataatacccttttgatagtgaatagtggatgttagttccatccaaatccttctattttttttttttggttggttgctgtgatggcatgtctattgaatagtattgccaaaattaatatactttttgattttgttacgaaatgtgttggctgatttgaacaaataaattagaccttcgtctatcatgtgatagacggccgcgcacggtcatactcagcgaacatgtatctatgcacaactattcatcacacaatgaatgatgcactgtatatcatattttacggtgcacagtagagaactcaagctcaaataaaaaaatttaaattttttcttccgtaggctggttgctgtttgacatatcaacatgagtaatgctacgataccataaaaataccggataaaaaattacatagctgtcatttaactctttcaatggagctaaagagggattttttttggtaaccagctaaaaagggatttttgtgttacacaaaaatgtcggaaaaggtattgctctattaacatagaggataaacctttcattgagataagtcaatgagctggcattatatagtgacatgtaaaggaggttttcaatataagcctatatcaaatcttgtctaatttaagacataagtaattgatttagattttatatttaaatttccacaaaatttcaataattacaaatattattttgttagagtaccaaataatgtaaaagaacagtctttagataagtattagcaaaagagagagaggaaaagaaaagaaatttgtagaaaagatcctcttttatcgaacctaattatatactactctagtctctcatgtatgctttgacattccaagttttcgaccgttgatagctatcatccttcttgttaagatttgacgtctcgagattcagtctacattgagcccatagtaaggtccgcggtgaaaaacgaagtccaacgagatcaagatcatctcaaacagagttcgaatagaggagatacgagcttttgaagtcggcatgagatccgaggtggcggaggaccgccgacggacgacggtgggcggcggcatggctgcaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcacgacccgagcccaagcccaggcgctcggtgcgggcgcggcccaggcccgcgcgcgtgggccggcccaggcccaggcatgcgtctagtcttgtactcaggtccacgatggatcgggcggtccatggcggaccacgtggaccgtctgggcgtttcccaagtatttctcgcggtccatggtactattccatggaccgatcataatcggatggcccagggacgtcccgatcttgatccaatagcttggggcttgatttggggtttgtttgggcttgattaggattcctaatcctaatctaacccttgtttaaggcctataaaggtctgggaacagtgaattgtgagggtatggcttcttggatcgtgaacaggcccacggaggcctgttttggatgcgggcgtggaatttcgcatggataccaaagaactcgagaagagagagagactactcgctgagagagaaggagcaggaggctcctaaacagcggataccggtcactttaggggttcaggagatttttcaagagagagagtttttgtgagggagaacttcaggagagaaaaattggatgtataagagttgagggagagatctcctcttgtaatttttttttcatagtgaagtttgcatgcctcgtggagacgaatccttttgtggctgatgcacgtattttgattatttttattttatttattttttttcctgctgcatcgcgtggtactgaaaaggttctaagaggtagtgtcctggtcagacatccatctaacacttctgtccatgtcataatttgttataatataaaatattcattatatctgtatgcatgcgacacaaggaattaagaaaagctcaaattttcaccctgggcttgcaaaatggtctaggtgatgtatgatccctttttgtgctgatctggagctgcgtattgaagtccttacatggagccaccaactagttccatgacatgatttgagagaacacttgctgcttaaacaccaactttttttttttggttaagaaataccaactcctttagccacatgaagcgcggataacaaaccaaaatgagcagctccagggatatgaaaaactaaatattaaaataaaatattataaatatattattgacataatattgtcaactttgatactaaaatagaaagatgtaatctaaaattgaatctgttatggaactcgttttcttgatcaagtagactgcaaggcaaaaattcaccaaccactgcacttatgatgcaatgactccaataatctagattcatcaaacataatatttcttcggtgcaaaaataaaaagatttattacagtttatagcaataaatattagtttatttctactcgcatctgaaagtgcagtaagacctaaagtataccacaaaccgacgcgcacctacttcaaaattgcatacaagttcgatcaattcctttgtttttaggttgactagataaagaattacagtaatatcgagctagcaactgatagaacccagtcgcaaaggactcgtgtttagctcgagccaagccaggtcaacattcgatcaagcgcaggtcaacaagcctcggcctgtttttgtaacgggtcggtttgtacccgaaagttccgatttcatgccgtctttcttaacggatcggatcacgcaaatccccaaattcaacctgatccgttttgagacctcctaggtctccttctcgccagatccgtcaaaaccaaacccccccacaacggcagccgagatttcgttctgccgatcggaacccaagtctcaacttttccaatcctcctaactctctgaaaaaaaaaaaaacatggaggtcagtgtttttctccctctttctctaatttcttggtctataaattcccgcaatttattcatcttcccttttttgggagagcagccggtaggtctttcttctgcgagcagtaaagattcgacaagcttggatgttggctctgaaaggaccctgtaagaaattttttcacccaagcatgatctattttcttggaatgaatcattgaatattttttttgtttgtctccctctctcgccctttttcttttttttttggggtaagaatcaccaggtaatttctaactcaggatttccttcgttagttgatccagaaaataatgatggaatcaaatgttgacacatttctatctgttatatttatgggagattttccccaagaaatttgaagcatctgtcacatattctgcaatggccattatagttaggtgcatttgttttcatgtgaaggggaatctaaatgcctgattggtccgaatctggatcgtgacatgtgataaatttcatcgcacataaacctcaaggagtgccatccagattgtgcagtgaattttccttaaaactactgcttatatccatctctgtcaatatagagcacttcttactagaaagttgatctcgagacaccaaacatatgcaagcatgagaagcaccagcttgttgatcataatcttctctgttattttgaatctacaattctatttgtggccaagcgcaatatttttggatctacaaatgtctaattttccaggcagaaatgcatagcggactgtaatttgttggaaaaactagtgggcgtaatagttacaaaaattctcaagagtcgtacttcctccacatttgtggtagttaaggaaaacaacataaatcagttgtatttagcataggtgatactgcacgcttggtgtttgggcacttttaactgatatttacatgtagatatgtgtgtttgcattctcactgtttggcattgttttcatttccattttctgaaatcatcacagccttaagcatctatatcatgtgaacaggtacccatatgtgactggtacttcagtattaggtgtgaaatataaagatggagttgccttggctgctgatttgggaggtcagtctatctgatatttaactgcataggaactttgccaagcataagatctgatactatacaagttgatttccttggatttatatatttgaatttgaccgtcatatcccacaaactcctctaagtcttccatgatatgtttatgcctttgttagcatagttcaagaacctgaatttcatgggaagtgaataatcctttttatactacgagtttctgacaaataagctccatatatgattcatattttcaaaaaaggagtgttcaccagtatacactattggattgatttttgctgatgcattatgaagcatggactggaaggtgagatatagatgacattaacatggcaaattttggaaaataaaaaaagttacgaaattgctgggatattgtatgtgtatgcataagatgtattcacatccatatccatgaactctatcacttagttatcattcaaatgcatagactacattccatacttcataaagtaactcaacattatgaactccagaaggaaccatttaccatgtccatcattaaagtgtcagcatctatacttgtattcaaactcctaagacccatatgccgcctgtcagatgttcatttggccactcacgtggtcaagcatgaggtgaaaaagatgaatgagtgctggtgagatagggaaaaatggatgaagtagatggcaaggaaaagaaaaggttccagaaaacaagagttcctatgaagaactagcatgctgatattattggaagtggtagagtcctgacaagagaatcagtggactttaagctgcagtcacctactgttatctatatttcactccaactagaaagatcactactatactgacttccatctatatctttacccgtaaaaaaatcatagcacatgcattgcacttgcaaggcaccagttccttcaaaaaagaaagcccttcaactcaccctctgagataactagcatcttgagcatattggggaggtatgcagtaccttttttggttttaaagagtaggatacttaaaattaagtcggtggcacatattctggctatgtctatcgcgagcattcgcatcctatatgttttggtacaaggtatacaaatcttacacattgtctgaaagttagcatattgtgtgcgtactgcagagcttggaccagctcaaatatgatgcaaaggctctgcttggtcatattgtctgaaagttagctatgctcgataatatgagggtttcctgtatttggagcagaaaaagtgggctatgacttgctttcaatttcactggaccctcttttagggcctaatgtcctaattatagctataagacctttttggtcctacattttaatgtagctaatgacattgtatggattatgtgcactcgaagtcttctaactgtgaaatctcattgactaataatgtttgattttcaacatatctgccaaaatgagacctactaaaagtaaattaaaatgtgaaacacctcaaattagttatgccagagaaaagttacataattactcagaagcaatcacgccttatatttgcaattcttccaacaaaacataattcccacgtatatgttattgatactatctacatctccaaactagagtcttaggggctttttacctttttttgttacagttatcatagtctatacaaagcagttaggagaagaaaaattggaaaagacgcaggacaatgtttgagttgttatagcttctaggacaaaaatcaaaacaaaattaagggcctgaagaatgactaaagagctataggagagagcacttgaaagcaaatgcccagaactagagaacttcttaagccgattccaagcagaagaggagcagtaacggagaagaaagagaaggcaatttttttctttaaaagtgatactgcattaggtaatgaggaaaattaaaatagaagatcagacatagaatatgctctttaaatttaattggttgcacaaatcaagtgtcttctttataatcaagtgtcttattctgaactgtcattaattgcctgtcatgtatatgatttttcatggtatgtcttgcaggatcttatggatctactttaaggtacaagagcgtagagcgtataaaagctattggtaaacatactcttcttggagcaagtggagaaattagtgattttcaagagattttgcgttatcttgatgagcttatgtaagacttctttaagagcaagctctcaaaataaacaaaatatatgattaagtgtaaactggttctgcatccttctgttttcctgaccatcaagttctttttgtagtttctggatgttctctatattttttttgtcttactcttttaacagcatttaagttgcatctctttttttactaattacttcattcccctctttcctcagcctgtatgataacatgtgggatgatgggaactcactgggtcctaaggagattcacaactatctgaatcgagtgatgtataatagacgcaacaaatttaatcctctgtggaactcacttgttatcggtggagtgaaaaatgggcaaaaatatcttggaatggtatttttatatcttttttagtgtacatctgtatgtttcttctcagtttccttccggttaatttagaaatgttgctattactgtatttactatggtggaaactgcccaggttggcatgattggtacacattttgaggacaaccatgttgctactggatttggaaatcatcttgcaaggccaatatttcgtgatgaatggcgcgaggacatgacatttgaagaagctgttaggctgctggaaaagtgcttgcgtgtacttttatatcgtgacagatcagctatcaacaagttccaggtatgattgtttcttgtgagcatcttacttgatcgtcttaatatcatgctgtatccttgaagagtagatggattgttcttgccattttaaccaaactatactggcttggaaattgttttattcagtcagaaagttgtttgctctagctttatgtttatcatttctaatgtaatggttgtttttttgttcgtttattttatgtgttgtaatctttgtgattggatacattcacagatgtggcccctctttcttatacaatgacctcaatttcacatttatatattaccatggtccattgttagattctgttagattacattattgtacttgcaatttgtttattaccatcactataaaaatttctttcacagcacataacattgtaattaacaggttcctgtctaaccttgaggaaaccaaacattatgaatgactgacgcactgttgtctgggaatatttctatccaggttaagtggaataagacatatgacctggggcttaaaaaaaggaataaaccagaatgaatctattcaatggtcttgtcagtttacttttatccatgtcaagagtatgaaacaagtaaaatgtttttttttgaaaactcccttctgcccttggcgggataatttgaaataaaatgggcaaagggtgtttatactggtttacgctacattatcccccaaaaacatatagggtctgaaaatttgatgtatcttgtgataattttcctaggacaaatcatttttttaggagtctgtttatcatttttaatattttaaactttggcacagtttaggcctagcgaatttatgaatctaccatcgatggatatccacatagcagcttttttcaaaaaaatcatctttagtgtgttgtaaaagagaaactagagggtcctatggaggctctagatcttcaggcggactcttttgaagctatcggtaccttgatgtgtactgcgttaccatttagggataacaaaatgcacctaaaaggtgttattggctatccctaaaaatttcagcatggaggtggaccatcaagctcttgcttctcacattccagctcaagtttaaccttactgggagttatccactgcatctggggttcagtcatccaaataaggcctaagttcattgcttatactaaccacattctcttggacatgatatgtccctctcaataggatgttcaatcttatctcgtacataggatgtgatgcatgtggaaaaatatggatggctgcagtcggggtaaaggagaagtataatagaaaataaataagccactataactaaatgctccatctctatctgaattgattgaccaatcatcataaccactaataatttatgagaggaggataatttagatggactaaacaaagagtcctccatgaacaactgaacattttctccatgtgcatatcacatgctcattgttagttgattaaaatgcaaggtgggaaatgacataagttgaaggacttcatatttaaactattaagcttttgtgtgatgtgatgtgcatgtgattagcagaataggggtttgtgttatagggtttggacatataataaaggcatattttagctagagttgttcaatggatgcacactacttctccataatcttgttgtgcttagagcttggcagaatctttcatctgtaccattttcggtctctcctttaccttgaggaagaatagggtgaatatttacttggactttcttttatttccatccataaataaaatgaatcagcctagatctggtacacttaaacttctttgctcaggcaagagttccaactgatgatctgctaagatgtcttttaatccactaagggggtaacaaacctcgcaagcttcttcttcttcttgatttaccagtggccataaccattaatactttatgagatttaatgaggataatttagatggactaaacaaagagtcctccatgaacgactagacattttctccatgtgcataatatgtgcccactgctaggtggttaaaatgcaaattagggaatgatataagttgaaaaacttcatattttaactaccaagcttttgtgtgacgggcatatggtcagcagaatagggattgtggtataaggtttggacatattagtataggcatgttttaactaaagttgtgcaatggatgcacaccatttcttcatgggctcatcatataagcctctccaaagcagttgactgcattaaaatatattagaagataattaaaatttataagaataaactgtgtttctaaaggatggctgtcttggttgcccagacacccatcttagtgctttgtatcatgtttgagtaatgttgccaagttgctgcttctcactcacttcatctaattggatatgtcatgggtcattttggaactttgatttctgtttgtgtttcttatattttgaatttattatttttgggctaccttgactttaagcacgagcctagcacctagagcacaaggcgactccttatgtgcccatctactgcccagtcttttaaaattttgaatataaaagaatggtacaatgctttgaattaaattagaagttaattaagatcaagtaaataaagtaaatacttgcatacttatttgagaatctattgtcatgtaacatggaaagtaaaccagtaaattacaattttttgccacaatttatgcatcaatattagtttatcatcctaaagtacatgctcaataatatattgtaatgcaaccggcaactgcaataaatgatgataattgatataagtcgtcaatgaacaactaatcaaagacaatgaaagtattaaaacatcaattagaaaactaggctgagtcctccccctggacaagcctaacactcaagaacaccattcctaatacttgatctgcttgaaaagatagtcaccaaggtttggcatactggtcgatatcggtgcatactgaccagaccatactgtgccagtactgaaccggtacatggtgtagagggtgtattgacatttgatatgccgaaccagcccctgtacctatctttctgatgctataataagatgctatcgatatggggtccagtattgagaaggtggatcttgatagtcacaaatcaacaaccatgtcttgggtacctaagcccaattgggccacttgggagctggccaggtggctatcaatgtaatatgggccacctaggctattaaacctttagtaggcagcttggtaaaaaggaattattctaatgttgcttcaggatctgtccgtaatgcatgcttgtttgacttcccaaatttacaatacttaaggttgttctcaccttgcagaaatataagtctttagcatggtggtctccaatttgacgtctcttctggaaacactacgtgcttaaagaacacctccacaaatcaaatcaatccgcatgacagagacaacctgttgtcctcagacatgagtttaccttcaatttacttgacatgcatctaagtacaagacatttttgttgtgcttttccacttaagccaatgtgctctggtctgatgaaagattttttcttttgccatctatatccttattatttttagggtgaaatagatcaatggcaacaaaatggctgccagaggggaacctggtttatattatattgtgaattatttttatagcttattctcggttaaccttatcaaagttgtatttcatagtgccagtttgattatcttgagccttttctctggtgctatccacaaaaaagcatatacgaggatatttcctcttgtgatttcttctattggcatgtccgatattactcaattgtatttggaaaattcaagagttgtttttgcactaatgaccttgatgtacaaggaaataccattcttctaaagcccaccatataattttcttcaggccaatgaaaatcatatgccgataactctttaaatccttctaccaatttcataaccaagggaacctttgtggtaatcatactccctctgataccaaatagattcatggatatgcttgtcatctgtcttaagctgtaccatcctctcttatggtttcatggtgtggctttgcagtttcgcgcaatgcctttgatctcagataacagaggccactagtgcaatcctgggttgtcaagcatcttcttgtcttcagagtctcattgtcatataataatttactggacctgtttccccccatgattttccatagccatatgaatagcattaaagtagacttatttctgagtgggaagttttcattgatggaactgtaatgatttcattcaatgcggctaaatgaacaggttgtcttatacatggctgtagtcctcaagattttctcaaaacactccatatattcggatgctttttcattgttaatatactaatataatttattctaaatgcagattgcaaagatcacagatgaaggggtgactatatctcaaccctactctttgaagaccttttgggggttctctgccttcaaagatccaaccaagggtgctgagggatcatggtagacgctttatatcatgcgtttcagctaaacttgaacgtcacataaaactgaaggtgttgaaaaagtactgtacttcttaaagttgtgctccaactgttttctttgtgatggtgaggggatattgaagatgatgctggatatttacgttaagatggtatgcccaaaatcatgtcgttgtgcttgatcaattccaagcttatgagaggtcagcagtgttgtgatgcttgaaatgattttcagactggtagtttgtccagaaagaaccattttatttgccagcgaagggcggtaatttcttcatacgttggcttacaattcttgtgatcattttgcattaagaacgtcttccttcaatataatgctccactggtatgcatggcgagcatacctagatttcagagactgcaaaggggaaagcatctgcacaagatattttgagaagagtggttgcggaaaattgcagctgaagacttacatggtagctttactctgtctggttcaggaggtttaatatttctttaagaatgcattctcgatcaggccaagatacttcttgaatgcatgtccctaccatgaggcctccaatctgtctgtctatagttttgcttcgtagcaccctttggaacccctcatttgtcgaacagccatcgtccttgcggtttaccctccaccctattctgccaaccaacttgatgagatcactgatgcaaataattccaatataccaggatcgcctggtatcatttttctcttgtatcgaatttagaatcgtggcaagaagagagcgcagttaatgttaggttggtatcatcaatgttccgtattttccatgaaaagatgtgttggagnnnnnnnnnnnnnnnnnnnnctcatctcatgcagaccctcatcaccctacaggggcacggcacttccaataacatgattgtgtttgcacacggaaagcaattgttagaatatttatagatatattttgttagcacgtttggaccggtggctgctctaaaacattagcacatgtacatcaaatggcttgcatgagccacaaccctcccatataatctatatattgcaaggaacatgcaactcaaactccagagaaccctgaccatgaagctggtccgatatccataccagttgtttctttttcccgaaaaatcctcgttgttttcggttatttctgtccgtctgtatttcctttatgattccccattcattgcccacgtaacagcagtaaacacagaagcaagatcaaaccccccatgacccaggatagtggcatctctcatcatatttattcttctgatgatggtagtgatggcggcggtggtagttgttgtcacgatgatgccgttgttgacgggttttattttggattgcacgtttgattcgtgcggcaaatgagcataccaaccttggggaactaagcggtcagacggaccggcacaacattctttaataatcatcaacgactaaaagacacaatagtccttaaaaacagcagttcacataattaatctttttagatgcgacaattatttgagagaaacttaagtcatgcattatgtggatgaacctgaccttgcaacaccaccgattcaaacattggtgagatgctgaacttttagggagcataatagcacaaatatcagagccacgttgcctaaccaaaggcccttgatctgaagattagaaatgaccacctgatcaacatcagatggctattatgtgaggacacagaagagtacagctgctcaactacatgttatcatgagatcgagcgccggacgtacatgatacaatccattcggaaacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggttccaatgcttccctccacgctaagtgtggccacctccttccctccaaatttaaattcgaacatctacccaagccccgatccaaactcctatgagtcgagaagaaggaccgctacctttcactcgccaaaacaagtcatccctctattgcagagatgcaaaactatcgatcaattcctcccaatccatgccgcaatcctcaaaactggcctggaccaagacccccttctgctcttcaagatccttcggctttgctccgccttcaagtccatggactacgccacccaaattttccacagaatcgaaatccctgatgtctatcactacactgccctcattggtggaaagattgctgccgcctcttatctcgatgccatccggctttacgctcgaatgattggcaagcccattgaacctgacctaattgtgatcacttatattctgaaagcctgtgggttgcagctggcattggaagaaggaagacaggtccatggtcaggttttcaaactgaagcttggttctgagaggcctattcgcatgaaattaatggagttttatgggaaatgtgggaagtttgatgatgccggatgggtttttggtgaaacgcctgagagagatgcggtcgctgcgaccattttaatttcgtgttactccgatcatggtttgatcgaagaagctgaagccgtatttggcggagtgcaagataaggatgccgtgtgttggactgcaatgattgatgggtgtgttaggaatgggagggcgaatagggcactggaattgttcagagagatgcagagggagaatgtccaacccaatgaatttactgtcgtttgtgttctatcggcttgctctcagttgggtgcattggagcttggaagatgggtccattcttatgtgggcaggtacaacatcagactgaatacttttgtaggctccacgctcattgatatgtacacaaagtgtggaagtattgaagaagctcaagaagtattcggcaagttggctgagaaggatgtggtctcttataactcgatgatagttgggcttgccatgcatgggaggagctatgaggccgtggaactatatcggctgatgattacaagaggtctaagaccgactcacatcacctttgttggtgttttaaatgcttgtagccacagtggacttgtggatatgggatttgagatacttgagtccatggtaaaggattatggcttagagccacgaatagagcactatggttgtatggtcgaccttcttggtcgtgtagggcgtttggaggaagcatatgagttcatccaaagaatgagcattgaaccagatcatgttatatggggggctttgcttggtgcatgtaagatccatggaaacttgaccctaggagagaaggtggctggaattttgatagagagtgaagctgccgactctggaacttatgttcttctctccaatgtttatgcctcattcgggaaatgggaaaaggcagtgagtgctaggggaaaaatgaaggagaggggtattcagaaagaacctggttgcagttccattgaagtggacaatgagatccacgagttcctattgggggatattaggcatccccagagagaggaaatttatcgaaagctagaagaattgaatgatgttctaaaattagaagggtattctcctgctagagatgtggtgttgcaggacattgaggaagaggagaaggaatgggctttggccatccatagtgagaggttggctatatgttatggccttatctcaactaaaccaggaacgacaatacgagttgtgaagaacctcagagtgtgcagtgattgccattcaattatcaagctcatttcaaaggtcagtagaagaaagattgtggtgagggatagaaatcgctttcaccattttgaagatgggtcctgttcttgcagagattattggtgaactctgatggaattcatccttgaatgcaagtccaggagaaaattctactctggagaagggagaaatttgattttcagtctaggcctcatgcttttcggctgtagagtaggcattgtgaaactctttgatataggctgcgaaagattgagtggattgatcagatatgcaaaacctgtggaactgtaattgaatttcattcaagaaccttactgtatgtgataacaatgttgttcatatttccacaaatccgaagttgttccatttgctgttatatgggtcatgaaatacttttctcatcaattgcttgcaccacgcatgcatatgaagtatgagttaccgtttcaaacatccaacttaactgatatgctagcctcttgacagcatctgcttcgctatggaaaatttagtcaacagttaccaggacatgagcttggtaaattattgactgaatttcatggttgattattcaacattttagccattccatctgattcagacataatctaacgcaacttcattagcatccagatatcctggtcgtgcacctattggatgcctaggatcttataggtgttaggaatacagtgaacgtgtggttgggaagtatgacaatttggtagcatgttccagagctgtcacttctaacttatattgatcgcagaaagtattggaaatacgatttgagttgcatgcaatgaagaatgaacgaagtctgttaaacttggatttctagttctgtttagcaaatattattggaaatagccaaagatggtcatcagggattgccatgatccttccaaggtttaatcacaggcctccccaaaatatcttgctatcttcactacacaagtgaagcaagttagatctgatgcctaaatgtgattctacagacagacaaaccttatacatatacctatatatgtatacatgcgtgtgcgtgcgcgcgtgggctgtgcgtgcatgatatgtgtgtgtgtgtgtgtgtatatagccaagatccttatactggaacaaacaggtacaaaatatacagatgggccatctttgtcccggcaatccactcacaacctcatttctgttatctgaataccgtcacccaagcacatcacattcactgatacaatgatcttggcattttactagtctatttttctttgttgattaatgaatttcacaagcacccataccaccattcagcaaaaatccactaaacaattgcaacctctgccatgtctatgaaaaggctcagaaatatgaaagatatttcactagtaaccattaaatattgattcacctccttccattagagtgatccaacacgccccacccccaccccctgaccaccccagccacacccaggcgggtgcaggagcacaaaggcgcatatacaatgcatgcacccatacccaccttgtctgcatgaatgcaagcacatagggaaaataaaacaagaaaaggagaaaaagaagaggtttacttctaactcaggaaatttctgttacctttccagctggattataatacttcatcttatcaattatcagttcatcactataagacccaaatactaaataccagatgaccaatcttgtacctaaaaatattggtactgacaagaatataaccgaccatgtgatatttattgaagcactcaatcactcaaagcacctaaaaacgagcttaaagaggtttaaagccttaataagtagatgatgcaaatcaagttacagggttaatatcagaagaaagagtttcctgcatgccgtcgtgtatacgatgtacaaaattaaagtttatgaggtcacattaaatctcaagtttagtaacttgttactcactatatataatcctgatagctcactataaccaaaaaaaggttaatgaagacaaaatgagaatacaaggaaacaagcatatactttaactcaaacaatatacacacaaaagtcccatgtttactctaatccggatattttctcctgctctctcctatcttctctctttaatttcttttttttgctcatgataagacaagtaagggtgataatgatcatgccactgagggaatgccttgaggataggatgataaactattcacacacacaaaaagggacactgttgtaattcagttctccatctaaactgctgcagctgaaagcttatcctcccacaaataaaccaaaattaatccagaatcacattagcgggttcatcttgcaatctcaagatacctttaaaattcatccctagtatacttcagataacaaatcttgttacttctgaactcttttagtattcattattcagaagttaagacttttgcattctcatccatgaatctgccctttatattgcacggtacataaacttgcttccatccaggtttttatggtcctcttttccatcctttctacctaaagatgagatcacacagtcacctcagctttgctgatttctgtcacccctagtcaatccatcccaaataatcaattaattgttctgtcccaatgctaatcataggcttcatttagttcacttatatacaagatttttggaaaaagtacaatttgagataagctcaaaggttacaaaacagcgggctcagatatctacaattgacatcgatagtaaaatgaaagaaaaacaaaatgattcataaaattgatggtcttaaacataaataacataattaagctggtgataattactcaaagcttttccataagatcaattcaaaaataggccccactgcatattgatgaaaagcttataccaattcagaagacaggaaagaatttaagcaaaatggaccaacaggatattgatccaaagaacttgcaaggatatgcaacaaaattttaatgattcaaaacttttcatgaaagatttcaccgcataaatcttaatttatatttatcgaatccagcaacttcgctatggaccagaaatacagatttgaagctcttatgattcatccaaataatgactagataaaggcatacatgaaaggtcaagttgcctggatagcaaaaacgcaagaattatttttgcatatagcttaatttgcagcatgtaacatttgtcattctagagaacttccagattgcttaaactaaaaagatctgtcatgtaagatgtcctaaatcctaacccacctttaaccttggaggattctttttctccccttacataacaacctgaatgcttcatctaagaactgaattgattagtcatagacctaatgatagttcatatcaagtaatcaaggtaacctacagcctgaaagttcagttgaaaactgacaaaaagtcattgcaggcagagtactggacattcctccccagctcagacctcaaaggaccaaataaagtgcagaaagctggatgaaggatgaagcagcatcccgttttattttcttttcaaacacctgttaaatcaatcttctgctaatgcaacgcaatggacaacaagaaactaaacatccaatacaattcttcccagattccagttaactgtccaactgatattagatgctggtacaccatcaaaatagtatcaaatttctgaagtcagagtcccaaaaaaacttgctcatggattgcaactaaaaaggaaaaaaatgcatcgcagattgaaccacaggcaaaatcaaaatcagttaattagaacaggatacaataacctgagattccagaattagtcgaaccacacatccaacagaagctatagactttcacgaatttcatcaacatcttattaacaagcaaaaactgaatattgtgctcagaaaacccactaatacttgtcgacaaagatgcaacatgatgtaagcacaagaatcacaaaacttgtcactacaattgattcaagttcaattttatataaaaaacaattaaacaaaacttccttgtttcagcatttcccaactcccaccaagacaaatatcatagatctgttcggtaacatttaaacaccaaaattcatagaactcattaatccaaatgagcaactaaataatatttgtttcaaatatttccctttcatttcagcaatccctaccaaaataatcacggataggaaaaaaatatatacaagcagaataagggaggaaaaatccatatttccaaaaataccaaacgactgaaaggatcagtgcagttgttctcagataacaaaagcatataacaagatcaatgtttaacaaaggtagcagttatcattattctgaatccaacacaattaagtaaaaacccaactttccatcacaatggagccctagggatcaccaaaccctcttcccccattacggggtatcccaaggcttgggctcggggacggcgacaaccataccttggagctcaggcgcgagtacgacctggcacccaagccttgcgtgcttgttgaggatccggttcctggaagccctcgtgagcacgtacttctcgtcgtacgatggaggggggagcttttcgagccactcctgcgcgatgtggacctcgcactcggcggagcaggcgtcgatctcctccaaccggtgggaggccgggtcgatgaggccggcgttcatcagggcgcggacgagggtctggccggagagccccaccacctcgcgcttcttcccgtcgagatcgatggcgaagagcttgacgatccgatcggcgaccttggcggaggcggagggcgcggcggaggagcacggccgggcgacagatttggaaaggagggagaggtggagagggattcgacggagaacggcgatcgccatgggtaggattttggtttcggggccttcgagcaaggcgaaggacggctgaaaggggatcggttttctttggaagaacgctggtacccttgtaacaaaagagacatggcagggtaattgatcagagatgtgtttcctgactacgaaagcacgaaatttggattacgtattccaatacgttaatacgcgccaaccatgcccaatttgataattagtgctcgggttcaactttgttttgtgtgtgtgtgtgtgtgtttcctctctctcttattgttggtattgataaagaatttttttggagtattggcttcgaatgataattttagtccgtatatcaatccaactcgcctcgtatggtatgaattttatccaattcaattaaaatctgagatgaatataaattttaaaaaaaatatttgaagtaaattttgatcaaatattgataatagtatatcttattttatattcgatccgatataatattaatatatattttttaatattataaaaattttatattatttataactattcgatccgatccgatatgatgtgggtacagaatggatatgatatgtgatttttacttggagacaggatcgatatagatgtgacctgatcattgaccattgccatctctgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttccaagtaccctttcgatccaacgaagcttgctttggaatgctctacgaacccttccaaataaccttggaagcttggacaagcaagaagaataagagaactcatcaccattaaaaatctcttctcatctcttttctctatactaagaaaagagaacactcaagaaagaatacaagtaacctctcttactcaatacaatagaagttctcttttatcaatccaccttagccgaacaagctacagcaccacgtaagtccaaatccaactaacccattacatgagttttgaaccaaacccaaaataaacccaataagttaattggtgaatttgatatcaccaaacctaacatgtgggatagggttcaggtgacttggtcatgcaaggtgcagtttccagaagtttttgataattggtatgatggtgcttctttttctttctgttttctcaattacgggcagacttgcacttaaaaatgaggcagagatattctttatagtaaattggcacatgagacttttcctccatgttgcacaactgaaaatctatactttctgtctgtagggttgatggactctaatgaaggggaaaaatagctcagatcaagctttgtttggaataaagattaattactgtcctatgcttcacaaattctgtctaatataactcttggttacttggttatgcagacgttcacattttcagaacaccttagaaataaattctgaaaaaatgtcactacccagagtctgctgagaaattccagaataaaaggcagcatgtttgtggtgaaactagtgggatgatgagtttaagaagctctaggagtttggcaaaagaaactccatgtgatcctgtggtcattcccaggcgttccccgcggcgtgtttctaaggttcaatctactcttttatttagaattaagaaacagtggaaaaagtatagtatcagactatttattctgtgttcacattattgttgtggcactcatgttttacaaaatataaacataataaacaagctgcctttattaatttggagtcaaccaaatggtggttcccaccctaacctgagatttcctggatagcaaatttttatcatttttcactcccttcaagtcttcttttgtttcaccctatcttttaacccttccaagctttaacgtttatctagttccattagatccacataagatctaatttctaattcatcattggattgtgaatgagaaagctttgaacccaacagtaggcttgagactagagaattttcactaccagattgcttccaatttcatcttcatgtgcccaatcatgtgagaaatcattggacgtcctcagttgtggacaactgctaatcatggaattcagctttatataacagtacttctaagtgttttaattcattatttatggttttcaattttattttttatttcttagtgacttgtgtgtggtaaatcatatgatggaaggttgaagttgtagaagatgaactaatgtcctcgtgttggttaccctctttgtttttctcgtttgtttaggcattttatgtctaggagctttagtaggttgtagcattttgtttgataagctatataattttcttccagttgtgtaccttataacttattcatgatggttttcttttcattatttaccattttttctggagtgggagggggttggaaacttggtgcatatggatccattcgtttatgctagatatcagtatatatgctacagttttgtcttttctatctaaattatgtcctagagctgtaatatgattgcagtatctgattggcttgatgagctatgtaatgtttctttcctaatcatagtttatcatcgacttcggtcttgaagggctagattcagatcattcgtacccttttctgcttgattatatagtttcttgtttcagaaatgtgcataaaaatccaggacatagaaccatccccctctcttttctcaaaatcaagtggaaattattggctgcaacaacctcatcttggaattttgcagtaccacaattggcaacatattgcatcaaggattttgatcacactagaattatctggcattttgttagattgcttggactggctgattgtccataagtaatctctttcggtcattgctgattctgtatatgtgccctctttccaaacatttggtttgtgttggaagaaactcttgacaacatggtacaacttcaaactaatatgtccatcatgtgtaccagctttatcttaccttgagaaaagcttctgtatccatcagtacttgacctgattgctgatgtcaaacactatacatattccattacatggagttagctgaatttttataccattacatggatatactagtttattaagcagcttctgtatacttatcagtgaaattccagactggagagactgcagagaggaatgaaggtgggacattaagaaaaaataaaacagcagatctttgacacttttggctttcctgttttgttaattcaatggacatggtcctgcaactcttttggttctaatagaaacattgcatgatgggtccttcctcctggcaaatgtagttgagcctgattttggcatcctaatgtgaccaagggcgcccacatgattggctcaagatggttggaagtggatactattctgcttctttcatgctgaagcgtataggaggcctttccttgcttccataatgctgaatttcacagctcaaaaggtacatgatctatcatttcatgcctctgtaggtaatattagttttatttttaattccaaaatggttggactggaatgattaaattctatcttgattgcatacatgagctatcatttctcctttaattgttgaaagaaccagtggtgaagaattcatcctgtaatctggaatttaaatttcagattatgctctttgctttcttcctctctgtatccactctactagtttctgcaatcaatccccttctagcatacttggaagatccttacaaaataaaatagagagttgcttcttttgcagtttcttataatctgatgaaaatccttccaacttttcgagtaaatgggaacggtcgatctccatcctcatgagcataagtacctaaattcaccatatgattctcatgcctctttggggtatcttaaatgaaaaatctgcccaattaaaatgagaaaacaatataaaataatgacaaattaaatgcatctaatttaacttcattgtcaaataaaaaaatggatattcctctgttttttaaaatataaaaagttttaggtgaggcttccctccttttcatcaaaagaaaaatcaaagcccatctaaattgcattttcaattgaaattttaatttacaaatcataaaagatgaataaaaatatagaccaatgaattgcaaaaaggttcaaccggaaataaaaataaaagtatgaatgtaagaagtcattttaaattgcattttcaacttgagagttattgttttgaaaattaaaaaaaaaaattcctggcaaaagagaatataagttgaagcatatgtggggttttcccctccttttcatcagcagaaaattcaaacattatttagactgcattttcaactgaaaacatcaaaaagtaattaagttataaataaaagaaatattaaaaagcttgcttgaaagtaaaaataaaatataaatcaaagaaaccattttaagtagaaaatgcaattgggaaatttacagggcaaccgcattgagcttcagttaactctattctgtgatctacatttatattgagtggttgagctacgcagtttcagactatggatcataataacccaagtattaatttgtccatatatgtatcgaaaaataggtttcgcatctagactcgataatgatcctaaccaatcaagtgtgatttagatgctgatgcgggcagaactggataatcatgaaattctatgataatgaaaatcactaagttcgcttccattttatcattgcagatcatccattgcttcgctggaaatggactaatgatcattttaaaggaaaatttatttctgctaagcagtacagtgaatcataataggctgtgttgcaatgatttttttgaaaaacaattaactattggatcagccttaaaattaaacttgaataagtcgaactgtcaaaagtctctggtcgagatgaatcattattttgccagctcaaattagttttgaaactcatcaaatcaacacttggtcgcaggtttgtctgcccctcaaatctataggtcaggatgtcgtggtttagatcagcatgaaattaacttcagagaatttatctatcgagattttgacagagttcttccttagaatcaatagtaatcacatggattgtagtgaacggtacagagccaataaactggcacttagttatgagaaacaattacgtggattacaattcaatgggacgtagccatgagaaaaagtcacatggattacagcagaattctattctaaccatttaatgtgatcgagtatggcaatcattggcacccgcgaattccatgcaggagagttttgagtaaacctctgccgctttaggatcccatgcaacatcccatcataacaatatggaaccataatttaggaagatggcattgatggcaagagccatgaattcaaatgatggatgtgacttgctggttatgtggatcattggatgtgtgcaaaaaattcatttccatcactcttcttgattgaaactcctctccactcaaggaacaagttgggcagcctggttccacgttatcgatattgttgaacaaaaagaagcataggtggtcaaatctttatctatctgcatcccactgaacttaggatgggacctttgtattttgcaagcatgagtgaacctgacataaacgtcttggttgctaaattctttgatttaatagaccggatccaaaaggataaaaaatcagatcgattgtgtttgattatgccatactaaaacgggcataatgttctcatccaaaatcagaatcgtttataaaattttaattcaaaaaattttttttatattttacatatctgatacttcactgatacaatttaatttttggttcagattcgttcattggacagatcaagatcaacgagagcccgaaagaccttggtcaaattgaaagttttaatttttcttcaaaataaatctagaatatttcaattgtttaagcatcaaattaaaattttatttttataaatacgatctttttagccaatgttgcagagagtctattttttttgatattcaattaaaatttttttaaaaaatttttttttatttttattattttttttgcgccatgcatcttctttctccttcttctatttttttttttttcccatcaaaatatggcctcccactgacatgaatagccaagtaatgaaaaagactaatgcaacccaatcaacaaatgttgttctcttgttgccgtcaccattctaaaccttctatagtggcagaccggcaggttatctgacgttcttgcattaatgatgatgccccaagattacatgcactatctataatttgttgccatttctataattaaaaaaaactcatggacacctacaaaagcttgcaatattatttgcttgaatcatcgtttaacaaataaataatttactcttcctatccgatgcaacgatttgatttgagaatgttactgtttggctaaacgacaatagatatcaaatattgttacaaaaaagcggatgctagataatgcatgtgattgagaactcctgaaacaggaggcgtccaaaagtatttgtaacggcggatatattaaaaaacctcgaagcgaaggctattaaccgttacaatggcctttaacggcatcatggtaatccaacggtcactttcgattgttttgaccgttgagttcaatgacggatcgactcgacgaatccggcttgacggattttccaagagagagagagagacagacttgctttcgaagataccggcagaaattatgcgaaaagatcacggcatccaattcttggtgcacgccgttgcgacaagccaacacgattttcgtgtgaatccatggagttttgcgagagagaacctccaaaagcccaccaaatcgatgaagcccacccaatgttcgttttgggctgttcttctctgttactggctcgttatggaccaggaggacggtgaagacaaaaagtcttgctgcagcacggcgctgcttgttctttaggagggcagcagtggtcactggtcttgatttttttttttgttcttttgggggatcgtggttggtctcccgaaaagaaagccagctaatcatttgggttactccttgatggaggttctggggggaatcacccgaggcttctgaagctggtggctggtcttctacttcgtctttgagtcctggtgatccaggggcgtgtcaggaaggtggtggaggattcttatttggtttaccggggacaatagatctcaactaccatgaggcttctgaaggtgcgtttgttgcttctgcttcttttcttaatcttccactttgttttggttttttttttttttttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtttttgtactggagatatggaaggatctaatgatatacaggtcatctaggttttgccaccttgtgttttcgtttcattggagttgattcagattttcttttgtggtgtagaagatgaacagattttgtctttgtgatccattctagattaaagaagggttggttcacccgaaaaaaaaagggcggataggaaaggagatctgttcttcttcacagcccattaaaaaatcatctcattgatattgtgaaatgaagatctcaagtttaagaatcaaaaaaggagaaaaaaaagctttctaatggaggcgtagctatagcaccgtaggttgaccacttgaaccaacagttctgaactttttgaagatatcagccaattgcttgagtgtagatcttggtattattgcgttgtgtttaatacaaaaagttccattccaccagataggtatgaagagaaagtttcattatgctttccactctcttgattctgctttacctcaatttactccataaagataaaaatgagcctggccaaactccaatttggagtttggttttgaaggactccaaaatggttttagcgaatagacatctaaaaggtaaggaaaaaagactgttttaaagtaatatgctgaagacacaagcggcttggccaggtctagatcacttggctagattgtcagcagtgaggatctttcccttcacagtcagccaagcaaaatctgagtcctcaaaagtacatgctttccaaatagctggaagacctgccacgaagacttcatgatttaagaaacttgtagaatgattaactgtgaacaaattttaaaaataaggatgatcaacacatacttcatcaacagctaaattaagatgccatagggatgatttgtctactggtctatcataaatgtttggagaatggagacacatcacataaccttgccaggccacctattcttgcagaacttcaaatttttttcctttgcctagaatacaataaattcgacactgaagcaatccttggccttcaatatcccctgccagaagagaaaatcttgaggaagtacagtgctctaactcagatgtcttattcttcttccatggtttagttgtttgattaacttatccatatctgaccaccttcaccaaagaatttctgccatcacttccctagcaggttctttagattattcctttgtgcttttgactcatgtacaaacttccgacctaacaaatatacctgctactgattggacccaaatggttctaaagaaaaccccttctgattttatcaaccctattagttacccttctaggcatctagaaggaagataaacaatagactgcagtgttggataagacagaatttacaaatgtaagtctgccatcaatggatgttacccttaccaacctgaaagtccctcttcaatcttctcaattggtaaaaccgagtcatcttttcaaagacccttaagtctgaaaggcaagccaagatacttcataggaaaggtcctttactacaacttggtgtttttgcaagctaatctccagtctgatgattgtttccaaagtagattagaaccatgtttcaaaagttgatgcaaagaccagaaaggagttaaaaagtataaagaatacacttatggcaaatactattctaggatgaataatggattggacttcggatgagaagcgcttagtgattaagaagctagagttcaacaatcagggtcatatggggaatccataatccttgaaaaattgggattccttaaatcacctcttaaatggaagaaaatggtttggctcactatatgttgtgattgcgaataagaagccaatggctgatggatgctcttcagattcagcaccccctattgctctcattccctgatccatgcagctacatcatgatacacgaggggctccagatctaaaaagtgcccaggatctaaaatgcttttggaagttgcagtcgccatacgggcagcctaaactttttcccaaatgtaatgcgttatcccagttttttgggattgtgtgctccatacctggccatataaagtatgaacatgtccttaagttacccacctactctggatcaactccaaaaacatgattgtatcatctgtgaagtactagtcattttctggtaggcccagtgtctaacctttactctttgctagctccagtattctgtttagctcatcaattacaaggagaaaatgggttagttggtcaccttgacaaagacctcttccacatttaatccaatcaggggtttgtacattcatagtccaaagcaagaaattctgcatatttaaaatattattaaaaaaatacattgcatcatgggttgatgttcaacctacaacatatccatattcatgcctcgcaaagtttgctaggatatatcctttttttccttttctagtatatttacatgtcagaaaagatgagtgaggtgtttaccaatttgtgttacccctccatatctcaacaaaaaaatagtaataattctacaccaactcctctttacttccataactttatgtcaaatacgatccctaatttatttggatggagtggtttctttccattttatttatctaattcccattctccttgttcctatatctttacttaagttatgcccttaatttacttgaagactaccattgatttccaaatcagttatctcattccattttttccatattaaagggcgggccttggtaccatgtgagttgggtctcataggtttgaaactcaaaaacagcttctctacacatgggagtaaggctacgtacatctacctatggtctgccataccatctcatgctctctggtacgggacatactatattatattgggaggaaactggtacaaaacttatcttcgagtcggtgcaagcctcgtttcggcccatattgagccattttgccacataccatggcataataacatgtatcaagggatattgactcgtactgaagcatattaacctgtatcgaggcgtaccgaaataaaaattgagaaaattggttaaagagctattttgatatagagggcgtaccataccatactgaactggtaaggtattaatacagtatccggtaccaagattaactttgtatctgaccctttccaaaccctagtggtggaagccacgtgcactaggacacccattgttatactcttctttttttcgttttctttttttttttttacgttctttccttgtccaagcaattgaggctctcactcatttgtttagtcactctagaaagggttggaagaacattgttgtgatcctatagctctttaaagaacaaatcattgataggggaaaggatatctagattgagaggttacctttttttatagtagtgatctttttagggagtgtatttgatgtaagatcatattattttctgttttatatctttctaatatttcattcccattttgcatattctttccttaaataactgactgagactcccattcttttgctgggtctctctcaagagtctctagatgaactaattattgatcatagattggatatctacattggagcaaaacttcttttttttttgggggtgggggggggtgttacctttttagagagtatatttgatgtaagatcatattggcagaacctttttaggaaacttaatttggtatcatgttaatcttattaaaaacctcttttatattatgaatgaaatgagattttaaacaagaagaagaaagcaagaaagtttttcttagttcaatattgaagaggtgcttttcttcaaaaagaattagtttaggagtttaaagtgctatacattttttaaagaaacattctttttctataaaaaagaatatatgcaacttatatttttactgactaattgttaatcaaaatgctgctgattaattgttaacactaattcttctaaaagaactcatgttttggaaagcttataatgtcagagatcattcttttaaatacaggtgaaaagaatttttgctggctcggcctttttaattacttctattttaatgctgtcagatcattgtttttaagaacgttaaggtttctagtattgatccagttgaaagcttcatgcagttgttggaagttctattgcttcttgcatcaatcagcagtttcccatgggcagctgcagacaacctcagttgcatgccaacaagctcgaaagtatatcgaccacacagagtcacagtaactgagtttggagctgttggagatggagtgacgcttaacactaaagcatttcaaaatgctatcttttatctacagtcatttgctgataagggtggggcacagctctttgtaccagcaggaaggtggttgacgggaagttttaatcttatcagccacctcacattatgcttagacaaggatgcagtaattattggatccacagtgagttaggaacttgttccaagtttaatctgcacttgttttagtttctcatgctcaagctaaatttgtaacattcagctttttatcttattgacatggtactgaatgtgcttgttgaattcagcaatttggttattacatgcatacccattcaacaatatgcaatcactagcataaaattttgccgatgaagtatatattttttttaaagtttgtaccgaataatgtaaagattgtatcctgccaatattctgaattttatcacctgccataaaattttgctgaatcaggggtttaaatcttatgctggccatgtctcgagtttccttgacttgttctaggtttgcagacatcaattttttatgctacatttctagtgaattcagtgggatatttttatccttgactcattatgcaagaaaggcaatcatatggttatgcccatgagaaatactcaactggaaatgttgggttcatttgatgttgttagaaaaacttggtcaacttatgcaaaggggaagcacatcaggccaatttattttttgtagagtaggataatgaacctctggttgggatcaaacagtgttaagccaaattcattgtgcatgactttaaaaatttaaccatcttgggagggaaatgagagatatcaaatcattttgaataggggggtaagtcaatgttttagaagagcgaagattcccttctctcctttcttcccccttgagtaggaaaaccatgttgtatgtatatcttagctaattcttcaaggttttatctggaaccttaatgatgaaaattgagtctaaacatttagataacccttttagcatgagctgaactttgcaagtcatggaaaaaatgctccattttgagagaaaggcatgagaggacttgaatttgaatggatagagaagactctcttccatccagaattgagatgttttgttcctagggtaaagaagcatttcatcgttttcaaggttgacatctgatctgcaatgcccccaattaagtgagcatatgggtcctcccctccccacaacaaccaacacccccctctccccgcccccgaaaaaccccgtgccacgaaaaaaaaaggcgggggggtccaaaaaggaaacttgtttttgtaaggcctacaatctacatacctctgaagaggaagttttatgggctttgcccctctggtccaaggtccaaactgttatatttgcaagatcaatggtctagcaatatttgtggctaaaggctctgttgggtgatgaggagaggctttactggaactttgtcatgaacattgttctatatcacaatttgatccaatcagtggatttctgaaaaatggaataatttagccataaatcttattatcaaagatgctattcttagctttgtgatatgttttcttataaaaatatagcagagagtctttttaaattaaaaaatataaatcacgcataacattcatttttttctttttttcctacctttttttactgtccatttacaaagccagaagttttttcttcgcttttcaggattcgtcaagctggccagttatcgatccattgccttcatatggaagaggtagagagctacctggtgggaggcataaaagcctcattcacggttccaatctgacagatgtgataataacaggtttgttgattttagccagacgaaacttggaggtactctagccattgtttctgtggattcatttgggaaatgcatccaattcaggaaactgtaaccattttgtttctctgctttctctttaaatattctaaacttacaaaataattactgcaacttagttttttctctgttttcttttcaaatattctaaacatactaagaacttactgtaatttagttcctccatgttgtcctaaagggcatcacatgtttttcatctaagtttttctgtggcttgacatagactatgatttcctggtttctctggttttcacataactgctcaccaatgtttcccatacctgtttcatggatttgggacaaacaatttctgtaccaacaaacttcacaaattgtaatgttgacttctcaatttaagaagcacccagttatgaaatagtttgttccaatttagttcgtcttgaatttttctttctttatttttcatatattcttttctgattgtttctgctctagatcattttaagatggaactttgcatattaattcactctttctgatttcaataactatttctccaggtgacaatgggactattgatggccaaggcagcatttggtgggattggttccataataaaacgttgaactttactcgcccccatttggttgagctcatgtattcaaccaaggtggttatctcaaatctgacattcattaattccccattttggaccattcatcctgtatattgcaggttagttccatcaagaattagttgcctttacccatattacttgatagacaaatggaatttggtgtgcttgggaaaatttgagacttgttttgctggatgaacagcaatgtccttgtccggaatgtcacaattctcgcccctcttgattcaccaaacacagatggaattgatccaggtaagcttcactatttagaaacttgaacgattaattgatgtttttcatttttcttttaaaagtcagaagtacattttattgttaataaggcagggcgtgcaagtattgctcattgtgcctttttgtggatacaagatctccagaatcttcttgcaaatcgaaggttatattccaaatgggtgtgtgagtgaaccagctgatcttctaaatacccaatgagcgtatgccaaaaactattataagttttttcgctgccagctatctgataaatgaactttgatcttctgcttgtggcagtgcaaattcttctttctgcagggtgctgaacactaagattccaaaggacttgggccttggataagaaccaatagcccaagattcatagaaccccaagtggatggcatcaagctatttttttggggtagctatggtatgaagttgttcaattatgctcttcatgcatagacggaaaagaaggatgtaaaatattataatcttaccaaaactggctgaaaagataagctgaacatgatcaaccaagtgatatgtatatgcatggcaaatagcattttcataattattctggaagtaagcatagagtccttgaattaatatgaatagtagctagtccattgaataaatggaccatcaaatatatttgtaatagattaaagatttttcagtctcatctaatgctctagtagtgtcattctagaatattacttatgcttcattagagaaattgaatgccaacatgtattatggagttttgtagacttcttcaaccagcttaataagataaaagaattgcagtgtcagaaatatttttctattttgacgtcgttcaagttctgtttattgagaaagggatggggttggggggaggagggtgggtggtgtttggggagttgcaaatgtagtgttagcaatacctcccaagtcccaacttttgcatcaagatggtggtttttgtggatcagaatctggcattaaccattaatccaatacttgcagattattttgaggggtttttatgtcccttgtttagaaaaggccccccaaataatgtataaaatcagattcattattatgaagagttaggcctggtgcttgcagtgatgacaccagatctttgacaatggacatttgattgttagaatagccatgtcacctgagattcaaatgtccatgcaggaaagcattttggagcattaaaccaaattttcctaattttttcttatccataaaattctccattaagtttcttcttagggtcaccattcatggaaaagcttaagccacatgcaaaatgtaggtattccatacccttattgctacaagataaggaaaagaagctattatgcaattccaatgcgaaaagctattctcatggcttgtgtttagtctcatattttcgttacttatatatcggttgtacattagagagatctttagtactcaatacagggccaaggaacccaaacaatgccctccacctagctttttgggtaaggtcatggttcattataaatgatattagagcacaagcccacttggtgttggccatgtggatttggaaatactacagcatgggcccatttggtgaggtcatggtttatgcggacttagaaacactatagcatgagcccatttggtgtttagcatgggctaatcatggtgtttgtgattagatttagttggattgattcttaactgggcaaggtcactagggttaaaagggggagtacgtaaaaaccggcttgtgtttagtctcatattggttgtgtggtggagaggtcttaggtacttatactaggccaagaaatccaaaaatatgttctacctagctttttaggtgaataactgaaatttgtaattgaacaacttctgtcatttcttaataatggaaatcttgtcttgctttgaaatgatgattatgttttccagtattgttatggttttttcaatgacttcaatctgtacaccttgcacgttctctgaggtcgtggcctagggaatgtttagccatcacatggtctgtgggtttggggcatcacaatctccttccttcaatcttccatgtcctcatcatttagtgtatggccaagtacttgttagagtatgataaactcaagactgcatatatgaattctacagtgtttccagctccaaaaatctgtgtcggatacatatccgagtcggatatatactgatatatactggttatttagatactcatgaagttctttggtagccacttttaaagattggaacattgttgaacttctctaacaatgagtgagttgaactcttccaacatggagtttactcctgtaatttgttattaggagtgagtagttctttcttaagatttgttaaggatgtaggtattgaaagaactttgcaaaatattattttgctaccatccttaagttaattgggaagtttgaatgagaaatatgtatattgaaagatcataccaatcaatctcttttttaacattttctttctaacatttaaatagataatgtttaaaggtagaaatgtgtaatttagttaaacttatatgtatctatcttttttccctcttgctgagtcagacactggatacatgtctgaatccaattctcatattcgttaccctgcaatgcagatgctacatgaattaaagactgaaataagttcataatttgtaggttgtattatgtggattgagcatggactttagatgtaggcatgctgaattgcaaagcaaggcttcttggggagtcaaaaccaataggatgtcatcttatattatgatcgaggaccatggaataaaaccttttagtaagtgcaactatgggcatctaaatgaaatgggatgggttatttggtaggattacttctggatcttcaaaggagtagaaatggagacaggcaattggttgaaaagatttatctgagggtggaagttttgaagagtaagttttagcttggttgtttgatctggggtttatcgtgattgcttttgtggactggttttcttgtttggcttcctgagatgtatgagggttctacttccaagccatcctagtaatgggagaattcttatgcatggtgtatgttctacttcccacagtggagactgacatgagttcaggtcaagcagcattgccgaggcatgaacttgtagtggttgaatgttgatcgtgagtttcctcaatcagaggttgaaatggagttgtccaagtcctaaagaatgttagatatattgtttattgaataagagcggactgaatgttctttgggagtttgtgcacaactcgaggctgaatctgagtcatttgaggcccaataaatctaagatttaaaatgtgtcattgctcctgctagtttatgttcatttatttttttatttcttgtttagttttgagttcctcttggcttaaacggtaaattatgacagaactgtgataccaattctgcagtggagaggtattttggtgagagaaatttttatattcatttataatggaccaccctccttcctctaggattatgatgttacattggtgaatgaagagcacaggaggaccatcgttaccgtccaatatgaaatatcttgtatttcaagagagtagttcccatttttttggttttgctaatgagaaagattgttaaacattcatgcaattgcaggattgtgatttaaactatagctggggaagctggagagaggtctcacttgtgacttgtttcggtatttcaagttttctttctcagctctgccacttccttttttttcttctttcattttttctgagcaatatggtggtaatgtgtcacaatcagaattgaaaccatggacctcccataagacaagcccttaggaaagaggggtcaaccaacaaagctaacagctattggatctcagatctggctttgctactcaacccaagatgcgcaattttccatgtgctgtgctaagatgatacaatgcagattgaacaatcatagtgtctaaatcttatgaataaactatctaatatgtaataacaaagtaacatgcaacaattacctgagaataagcagggatttgatagaaaaatgtaccgctatatttctgttattttccattatttttctgttataatgaccaaagctttcccataaacagaaaatctacctgtcagttaactgaggacataatcaatacatatcatgactcatgagtgtacctgagaaatgggatggatccatcttttaaaatatcggcatttttaatttacaggaatgccattttccggtacctagaggaaccagttaccggttaatgaatatgaaccattctaaagcagtcagtgatgcttgccttctacagtggactattactgttactgtaccttgattttccatggtaaaacactttaggtaccatagatggaccacaaaaaattgttgatcatatacacattgatttatgcccctagatctaagcagttgctaattttctttcatttgtcagtttatagaatttaaaaaaagtttatgtccatagccttttaaaaatgtctatttatttttatatgatatttgtgattttgtgtgatggcaattctttttaatttgccccctctagttaataaaatttagccctttatactgcaagtggaaatgggagtataagctcaatctttgatatccatttaacacattttcctctgctagtggtgcataaccatggtgagaatcctcatcttctcatgaaaaatgaaaattaaatcatcaataaaatgattctaattttaaatctgtgaaattattcttatttcttcttttagaaatatctagcacatggaagttgttttagttttcctgtcaatactgacttgatgttattttatgtaaatttctgtgattggaaaaaattttggtccctcccctgcttattgtgcttttgttcttaattatcgttcttatgaatatttctagagatttgatggttgcctttgtttttacctcttgctgattggatctgaacttccactcctggatgttttttttaaaaaaaaaaataaaaaaaaaaaaaaaactcaaattgcaaatgttataggtggaaaaaaagaagtatcttataatttttctctttggatcttgatgaatattcacaatgttatacgtgaatacttcggaaacttttattaatttgaacaagaaaatgattgaaaatatttgtttcatgcgtcccagactcagcaaacaatgtctgcattgaagattgttacatcagcactggtgatgatctaattgcagtcaaaagcggatgggatgaatatggcatttcctttgctcatccaagctccaatattagtatccgccgcatcactggagaaacaaaattaggtgctggcattgcgtttggaagtgagatgtctggtggtgtatcagaagtttgggcagaggacatccacctctttaactcaaagcatggtatcagaataaaaacatctccagggcgaggtggctatattcgaaatatctacatctctgatgtgatcatgaagaatgtggacatagcgatcaggatccaaggtcaatatggcgagcatccagatgaaaagtatgacccaaatgcacttccaatcataaacaggataaccataaaaaatgttgcgggagcaaatatcagacttgcaggtcttttagagggtattcacggagataatttcagcaacatatgcctatctaatatcatccttaacgtaacatcccctcatccttggaattgttcatatgttgaaggttattccaatatggtgtctccagagtcctgtgagcctcttaaagaaatacctgaagattcttctatttgttacccagctaatcatttgaaaccacaacaatccagtgcaattcgtttgattagtcccttcattaagttcatagcaatgtaaccaaagtctggcgctgtatataagttggaacttctgtcaagggatcttcatttgtccgaaatgtttggttttgtatggtttttcaacaataaagtgtatagagttttggggtttccgtcatgtaagtaattgtatggtgaacagctatatgaaattgattttttttttttccttgtaacatttttggcaagcaatttatttgagatgaggatcttgtaagagaacagggcttgacagtcaaatgcatgagtggaaaggcaccatggccatgccataaccatgatcaataagctatatctgattttctttccacatttcattggtcaggagatggcagaagcctgtaagtttaacaccttgaaaaatgacatctttgtgtgactagaaccaattattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatctgctgatcagagggttgcctattccttagggttatgtatttgccttccacccaaaaataaaacttatctgacattttctttaattttagagtggtatcagtcccactataactggttgaacattgtactacatttttcatatgccaattgaccaagtacttcataaccattttatcaaaagatccatttgatcgctttgagaactttgtaccagatttcttaggctgaaacagatacaattatatcccagctcaacatttttaaggatctgctggatcaaataacaaggaaatgatcgtttggagcataactgtcaaaaatgttggtcttcataagaacatttcaaaattatacaaccatcaaattggtacgatcacctaacaacaagcatcatcttggttatcacaaaacgcaacaaccttgtggatgataagacatcactatgtagcacttccaagcaaagtagaaactgccttttgatatatgttacaagaaaaaaaaacttatattaagaagaccatgaaggttttcttaccggccttgccactaaacacacagaaaaacagcttcatagaacaatatacaagttcatttggccatgatctcccaacaacttgttgagaaataattcttccaagagtaatttctgccaaagcacaagatacaatccaactagcagcttttgatgagaaatttttgatgagaatttctcaagtgttttgacagtacgctgctgaatcgaatataaaaagcattgcagttatgaaagcaaagaacaatctcatttgggtttgtcataagcagctatgttttgaggttcacactctggactaaagaagcagaccagcagggccgacgttgagcttgctgatattgctccacatgaagcccacctgagacttctcggaattgttattcttgggcctgcaatagaatgataaccatgattaactgaggcttaaccgttcaagttcaaactcctgtcaaataaggacaagaagggccatacatatgtgaacatttcaagttaaatgggcgacaccaaagcttagtttgcaattattaactataacaaaattaacttataaaacaaaaacatgctttagaattttataccctctttggcaagccttcaatcacataaaaagcctttacaaaattttgtcccaaaacaaaaaacaatattaatacctgagagttcggtaagctggaatccatgcatatcagctcacactgaatgggttctctgaattctgataattttcacaaaagaatatccaaaaagaagtaggattgaaaataaaccatatcagttcaatcatttgaagcaagttacaattagccagatttgggaaaggatatcgttcattgtagaaccctggttgctctttgggttcaagttgatttattttagcacattacttacattaggtaaacaacttcatcattttttccattttacagctggaagaccacctaagttcaacagtctttttcttttcttttctttttttcatttatccaaaattttaacaacctaaacaatataaaaacctctggaataccatgcaatgacaagttggttcatttaacaagggtatctgataatgataaccaaatctaaggcattacgacaaaagagagccaataattgatgatgtaatattaaccaggatgatgtacattatggtcccgtcctaggatttattctgcaagcaaaatttgtcattacaagggaagtttattattgttattgttattgctattgctattgctattgctattattattattattattattattattattttgtggtggggggggaatcaaattagaaacaaccttcttttctaagattttattattttaataccaaggaggcaagctgttggagctagattcttgtgaaggaattaatgaaaagattaaagacaagtgaaaaactatacatctttaacaatacaagaatgatcatagtgccaacagaaataatttggttggtcttaattaggatctcaaacggactaatgcttaaaccatcagagcagtaaacatgaaatcaatgtcacatgaaagtagtatcagagatcaaaatttccaactgcaatgagcacagaagcagcatcactcagaagtcctaatctctttaggcaagttgtatgggaactgaattactttattcacgaagctgcatggtcatttgtaggatatgtgatgctggtgggaagagatcacaatcaaaactagactgaagtaattgagaaatggaaacgctataaaaagttgcatgtcaatctatccatctcttggttttcttattgtttaattttgtttttaatacttgtaattttgaattacagtgtaaagatggtttgaattgaggaattagacgaattacattctagggtcttcataaatgatccggaggacaaggttgtgtgatgtgagggagttgtgctgaatcaatgaaccttttccttttccaaggtaaaccattaggatatccaattcaaggtagcttctttttacatggatgtcctaattgagatagtgcaagtactagtgatcattgttatattcttgagtggatattctttgcttttctactcttccatagaaaaaatgatgatgctcaaatgtttagttctgcttagcttcagtgtgcatctttatgatgagttagataatttgtctttctaggtgttatctttaataaacttaccagaaaaagcatcatctttgatatgatatttctgtttttgttctagaccttctttttggttttgaaaagtgatgtgaggtttttgtggttctcctttcatccctctaagtttggttggtacttcttgtacccttctcattccccactaatcaactaatggtttcacaagtggtttgctgctagttgttaaacctcgaagcacaacatcttttgtgatttaattatttactctaattcctcttcagatttggtgcccattatgaaacttttattttctcaacctttcaattattctacggagggcatctaatttcaaaatcaatagtaaaaagagttcagggaaaaccaaatctaagatgcattttaagcataaaaaaccaaacccagacttcaagtcagaaaccatcttcaacaatagtctaacaaccacacttcgtcaaactcagaaaccagactttgttggaagtaacaactattttataagtagtcatatttcaacattaaatgcaccattaatcagcttatcatatctgttaacatgtatcacggtttttcataaaaacacagagaaaatagctatatttttatcatctcataataccacatcctagtttagaatttacatagatgcttctcaggctcttgcacctttgcataaacttcactcaaacaatgatcggcaaatccaccttcactcaaacatagattgcttatggtcataacaaacggccatggaattgtcaaccttctaaaccactgggaatcattatcttccaaaagataccaagatgtcacaatgattggcaaatccaccaataacgaaattttcctccactaggagacttgtgacaaatatatacccttttatgttttcagccacagcattatctccagaagatcatcgacaacaagagaaatagcactccaaaaaattaacaggtgttttccgtacctgacagaaaaatcaaaaccaacactggaaaatcaaaatgatacccatcgtgacgcttattcttaagaagtcttttatcagagctggttctggtcatccagataataagggcacagcagcgctttccatcagaaatccttcttttggtttacaagggagacacgactaacactgtctatagcatctaaatgataaagataatgactttcaatgataatgtcgacgaactcactcaataaaatcgttaattcactcagtgaagagaaatttgggaagcagtttccaaattccaacgctagatccccgaaatcttcacctttacctcgaattcccacattagtctgtcaatgggtcgatattaaagtctaatacctatccgtagacaagcacataacatgaaaaatccattcttcaaaggatgaagaagaaatcatgaagagataaaagacaaacacttacattcaaaaatcggactatgtgtgcaaacagataacaagcaaaactttaaaaaataaattaaaaaaagaagagaaagaagggaccatagtggaggcgacagaggatccagaaactcagggcgccgccgacgctgaagatgccggcggtttggtgcattagccgggagcagggtttcgcgtccgaccgcatcagctcgccatccgaccaccccagcgcccgcctcaacgccatccgacaagtcgaggtcgttcctctctctccgcctctctgtcttgcccctgtatggctcgctccgtcagccgccgcagtaggagagagaaatgcagactgtaggtatcagagagtgatgagtcagaccttcccccacacccaaaaaaaaaaaagaaaaaactttaccaaaaaaaaaaaagaagtggtgagtcagacagcggaagcggaagggggccggccggcggcaaggaagtcggatgccctcggccgcgtatcgaggtacggagtggctccggcgatccgacgctggtgcaccaggacgggcgatctgggcaggcgtccgggccggtgtcttctatcctccttcgccgccgtcgccgccgggagacttcggaagacgaggacagacacacgagaagggcgtcgcggagagatcggagaagagaggggtagaggagtcgaacggagaaacctaaagccctaaagggaccagtggagtaggagaatcgaggtggaacgttgggtaaattataacgaaacccttctactttgggccagttacaattaaccaccaaactttcattttggttgtaatttggcccatccgtccatgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagctctttgaatgtctttgcttgatctcttctaggtactatgctaccatattcatggtagaacacttttctagctgatcagtgaggttgttcaaattcattttgaagctactaagcaccaataatgctgacatctatgacttgttaaattataataataacaatttatcaatataattttgacatagacatactgatgtatttgctgataaaaagttaataattgatagctcttaactttataaaatttgatgaatttttttcatgattatcataaatcagatttgattacataattttacagttaatttttactcttgccatacaaattgagaaatttggatcaagttctactatatttcatcatgcgggaactaagcatacttatggttttttctaaaaaaaatttaaattcacaaattaagtgcattttgctagaaattttccttgctaatgtatctattgatcagattaaaaaagaaatcttcagcaggtgcatgtgtggtaatgatagcacaaccgtcaaccctgtcatgctacaaagaaggcatcttccttccatcattaaaatgctcgagatcaagatttctatttgtgtcatacctccagaagcctgtctttgtttataacaaaataatatgccctccacgatgcttatcgtgcctagctgtaccctcactcaacaattccaggtttgctattatcttttcaatacccctggaaatttccattgaatgtctgagaaaagacaatgttgcttgaattatgaatattttgcctccccttagaacatcagtaagtaagtatgatttccaaggttgcatatcatgtctgagcttttgcatcacatattactttatattatgataaccttgtattttccatatggtaagagatgaagtacaacattattcaattagaaattgtaaagatatgacaagaaaagaggacccaaaaagaagtgttagtttataatattacaaatgattgttcaacgttttgatgattgcgctagccttttgtctctcataataggtgaggccatgggccctatgcctgttatattatttggccagttatatactagattaaatctacctaatccctacatgacatgcaaaataagtactagattatttctacctaatcccttcataacatgcaaaatgtacatttaaggatagagaggatataagagacaaaagagaatgcaacaataaaaatagtaaacacgaaggaatttggaggaggactggcaataagtggttgtttgaatgtaccattaatccatccacagataagccatgattagtggctgtcaaccgtcttaaaatggtgagggaaaggaacaatggaaccgattgagaggggcttccaagcactcctaattccggttttctaaggtaaagactcgatccaggaggtgtttttccttatctctaaattatagggattaaagagctcgatatttcgtgaaacaacgaaaaagatcactttgataggctaggttcttctcatctttatccagaaatggaaatatacgaagtataaattagatgggcatccaaacagcccccaagagaaagggatgaaactaaaatagttaggaaaaacatctaaaatcaaaaaaaagatgcttttgatttataacaaaataatagaaaaactagatgactttgagcacatgaagaaaacatacggatagaaatacaattgtttaaaaagaaggaagtatgagtggaagttatagatgtttgaaaaaattatgtttcaattgatattcaatttgaagacattaatccttagctgtcaagctatacatgttggagagtgttaattgtaaccgatacaaaatggcatgatacatcgtgaaatgaaagcgattatctacactgctatataaagagaactctgggtgcatctagaaaaagagcacaatattgaaagccaatcattggttttgaaaaaatccaatcactttagggacatatttaaatttctacttatgtttaatttgattgaaactaaaatccagtgtcagtttggattttggaactgaaatggccgtatagaaaagttaagggaagcatatgtgagaaaacaatgcaaatccagacaggaagaaaaggaattaaaacaggtcatacagctaatcctctttatctttctatatctaaatatgctacatgatatagtatgtgcatatataatcaagttgttggactctcaggttctgccgttctgatatcgctatattcgacttcaatctgatgtgaaatcagatcctagaatctgacttcgatccagtaaggttatcgaatactttaattggatccatacccagttattacaaaataatcgagtcgaattgtcaggttttcgggtattatttgtacacctaacatggagaagatacaatttgtaatagatattcttgcgaggcaggtatcatactattcttcctcgatttaggatgttctatattatgtgagagcgtaattgccaagttacgaagcgagcacaataaacaagagcaggaaatgattgacaaaatttgtataatatggaaaacatgaagtatttatgtaaagttataaaattcattaatatatttagtatagaaaacaagaaatgtatcttataaaatttaaaaaacattaaaatctctaacctagtcaacatccttcctttcttatttccttaaaaatattcaacaaaaaaaataataaagattagttgaggcaaatccataaacaaatttctcgattctacgggtggaaggccacaaagtccaacgattggattctttctccaatcattgtctatgttttttcagaacaacaaaaagtagaagaggtgaacattttcattattctcgtttcatggggcttagcatgtaattttctaggcattgggtcatattttatggcttcatgtatatcagtaaatagtagaattattttagttaaagacagcttttgaatgttttagatttcagttttcttttcttttctacaaatggtgggactgagacacatcaggttgagagaatgagatcacatggttccttattctttctccactcgttgtctatgcttttttaggaaaaaaaaacaagtggaaaaggtgaatgttgtcattcttctcttttcatggggcctagcatgtagttttttaggcatgcggtcagttttgtggcttcatgcatattagtagatagtataatcattttagttaaaaggcggtcttagaatgttttagactttagttttctttttctttctacaaatggtgggaccaagacacatcaggttgagagaatgagatctggcagttccttctcatccaaactccggattggttatttggacgtgaatttcgcgtttcttaaaacatgttttactcttgttttcttggttttctttcctggaatccttgttggagtagaaaatttgtttcctggcattcatgtgtgagtataaaaacatgctgcctattatttaaacccaggtgtaagcttataatcatcttatcaaagagagaatgaagagggactgcacattctagacttaaaggtttgtgttaaattctatatttagaagaaatagcatatatttaatgaaattttcatgcttatgataattttggttagaaagacaatatagtggcacaaagtcagctaatcatggaacacagacttcctgtagaacagaaacacttttcctaggagatgtcctgtgttgtaatcatttctgttttttctatgccccttttctttagaatgagtacattctcggcaaactctttgttctcttttgaggatatagggtgcatcatatttgtacagtgcccactggaatttagaagtctttttctgtccctgccaagttcattcccaattttgtcagtttagacatcaggtgatttcacttcatctgtccctgaaaataaggcttcagatgcctgtaattgcaaacgagattatccacttgttagagagccaacatttcacgtatgtttttccagagttttagccatccgtcaaccaataccagctttttctaatgagcagcgtaaagcatgatatcttgttgctgaatttggtgatacactacctatagaatgtaattatcctctagtaaatttctgcaacactttctatagcgcatttcttttagcatgactacctgaccccacatacctgccctgtttatcaaaagggaaccattcagaatgtttgaaaacttatattgttttggaatatggttctttcatctctttatccatttcacttgaccctgccaacataaaattatattcaactccagtttccctgcagaaaacattaccctcaacataaatgctatttatgtattattatgacttgcatataatcatttcagtttttcacttttaattgaacaagcttcacaaattccattcaaaaaactatattaactctacagcattctctagaaaaagaaacacaacatggatgagagaggactagaaagttaatttaaattaattaaatatttgttaatgatagctaacagtgagagcaaaaatatcttttccaatgatggaaaatttaattcgaaatatcactttattgttgcattcaaagttgtgcatcttgatccattatttatccggtgactttagaaaacctgtatttaacctgtacttatactatttaaggaaaataagtactgtatgtaattcacatggaacgtgtaatgaagctcgcatggattgtggggtaaacccttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcttatacagagtatagtacttgatgaaaccacttccggtaaatcagagcatctcactgagatgtaaataatactcgaggtgttgaaagcatttacttcctgcttcccaaagacaccaacattcacgttaataagtccatcatactgcaattcaagagtctaatagcacagccagagcttgcattcagccaccccttgtggaggatgggggtagacggaagaagaaaaagccaccaagatcagaagtaacaaccagatcggcaggatgatgttgtatcttaaatactgtagcaatccgtaatggtagcttcctttcattcggtgcgtggcattaagatcttgctgacattctgtatgctagcatttacaagcaagtagtttgccgatttttaaataccgaatacaagattttgacaagttttaaggcaaaatggaagagaaataaagaatatattacaagttttctttcatttttttttttaaaccctactcatcagccaccccacgtgcaatcatttacaggtgatccatctattttaatatattacagctttcttagtaatactgacagggaggccgaaaagttgggtcgataccatatgccttacaaaaaaatacacattacgaaaatgcaccaacgcctttttcagaacttagggttcttggttttaggctgagaatctgtagtaacatgacagcgttttaggaaggagtcaattgttttctgcttccttgggctgtccactgttttctgttttacaaggctgttgcttgtttgactggtagacacacgtaatgcatcctcctggccatcaagcatctgcgcatttaaaaatcacagttgtaagatataaaatctataaaatatatcaaaatatcaaaaaataataataataatcagatcatgtccttagatgaaaatatgcagcagaaattatatcaaaagagaaaggtatcaaaaatggtacaaaagcaagatatgtaccggtcctcctgaaaatgagatataggttgaggtacagcattggcaatggccaatgtaaatcagattggtaagcatcctgggcataattatactcctattaatttataagcctacatttgttaatattgacatgaccgaaacttgcatatgtgagtttgtgaatgaagaaggatggaatctatgtgggcttggggagagttttgatgccagggcctgtttggatacttaaaaataccagattattaggccatactgctgtatttgaacattgctgaaagctttccaaagatctgtttggatgacattttcagagtctcaaaataatatagtattagacaaaagcattggaatatcagcgtattttaaacattcacaaaaatcaccggaattccaattccaaagcttattaggctctcagctactccccctcatgccccatctttcttttccattttcattgtcacaaccagcctgaactttcatcactccccctatggcaatgcaacccctcctcgcttccctcgagtgacctgattctctcagatcacttgaggacctccctggtcttctccttttgcaatcttagatctggcagctcaacccccctaacgaacacaagccacatggccttcccctctgatgatggggttggacatgcccggcaccagtaataaggatggcgatgattgggacaggtgacaacaccaaggacggcaatagtgatccaacttcaattgatccatcctggcaccccaccatggctaacaccccagaaccccatcctcaactccagtggatcctcacctgtgtcatcattgtttccccatgttaaggctccatctcccctcaatggctgccatccaacatggttgaccctccacctcccttattggtggtcccaaccatcggccctacctcccccctccttattccaactatgactgcccccgaaccaccaccaaaccatcatcatcagtaccacaatcacctacaatacaaccaccaccaccatcttccatgcagccatccaccaacatcaccaccatttctactatcatccctttgccgtaacctctaacacatcaactttatcaccgtcactagcagatccaccatcacctacatcaccatcctcaccatcacttgagaataaggttcgtcatctctgtaatggaccccatattggtactatcctattacagcattgagtacacaccgagtgtcagtatggtacccacggatatgacaaaccttgcttaagaatatataaaaaaatgggaagatagtggagtgtagatgagaggagggatttggttgtggtaatgatggtggttggctagaatggtagtgaggggatgagagccgcaaggatacaaaaaaaaaaaagaaaagaaaaagattcctttatgaggcctgtagcctggcacatgagttcttttaagttcaaccacaatcttccatattaactataaagtctcgatacgatgggattcccctccaccctcttggtttaaaaatagcaaagatggtttagttgtcctggcggtcagctgccatgtgctgtgtttatcctattggaatcaactgggtgcccaactgaacctaaaggcatggctgcctcattgattctcagctcttgaagcttagacccttagggaggccctatttgtggctcatcagtcccagttaccaaggatggtcattaaaaatgattctcgccttaatatcaatcaagtcaagtgagcccaccccttccaacctgactgcatgattgtctcaacctgatggatggtttgaggaattgaagctgcaacatattttcaaaaataggtattgttgcaaactagattgctaatcaaactagggatctggggcaatcgtgggttttgagtgaatatgaacctggggaacaagggaattgttttgtctcatgatatattagaggtttataacatatgtagccaagggaattttcttgtctcatgacgtattaggggtctataacataagtatgtcgaccattttcttaacaaaaaaaaagcaactataatggtaaaaaaactgcaactataatgtgggacacagagagagagagagaaagagagagagagagagagaacctggcccaaattctccaatttgctttggacaacatccctgaacgaaaaaattgggcattaattcacaactgtagtactaaaactgctgcaagcataatcatctgggcaggcttaccagattatgtcatcaacagtgtcattagctagaagatagtatatgttaactgatgacgcctgagaatgcaaaagaaatggaataaaatccaaaggtttcaacatagaatgatcttataggaaattaaattattctagtcaagaaacctccagattgctaaaacagagaagattcagcaatatagtccaacattcttaatgcatgcttgggaagcccaggatgcgtcagtaaataaccatattatacattagataaattacattacatatttaaccttgatgattgatctccatgttgatacagagaccagaataacatgaaaagttaaaaatatgatatcaaagcgagagtaattaatcagtatgaaaagatgtaatagataacactacagataaatcatttacaaactgcaaaaactcgatttcttggctaagtcaaagcatcttcctggagttccatatatcctggaagataataccattctgaatcacaaactatatttttgtacttgaggaccttgcaccatatactatctgtaaggacattccaatactagtgtctgcaaactgcaaaactacatgagaaaggaatgcattaaggaatctctacctcgcttcagaaaccatatattgaaggaagcatgctgcaactaacaaaaatttagtaacatcggccctgttaaaaagctacggaataaaaattgagaagccatgaatgaacattgcagccttttgacaaaattaatactttatcaaggttctctatagaggactagaagtttcaaattaccaaacatgtaaactaacaattcaaatactacagcatgcaaataaattcatgtcttcaagaagattattgtcaatctattaaaaactctaataaacatttttgaatcttggttgcatgcacatagaacgagaaaaaaaaaatggtgcaacaacaaagaaaaaggaggcatttactttgaagacatgaaacaaaaaaataatgtcaagcaacagcaacagtgaatcaaatacttttccttatacctgcccaatccgatgagcacgatcttctgcttgaattatatcacctggagtccaggacaactcagcaaagataactgtacttgctgctgtcaaagtcaatccaacacctccagctttaatagagagctggacaatatatgttatcaaaaattagaaaattagaagcaagagggaaaaaccaagtaggaaatgaattgaacccataaaaggttgaaactgccttacaactgcagctttaatattatccttctcctgaaagtcattgactaaagcttgccttgatgatgatggtgtaccaccatcaattctaatacagctgactttctttttctgcaacaaattggtgatcactatggagcacagatcaacatttggaagacactgtcgaaggtcaagatatcttacaagcaagaattggtgtattgcatcaatcatacattgatgatgtgcaaatattaagaatttgcagtctgcctgtaaaatgaagataaggtggtcatacatacttgagtagtcctatgtaataggatgccagatatagtaccatgcaggccaacaagctaaagaagttaacaataaatagaaaaaatcacacttcgcggtcatgcaccaatttactaacagaatatattaactgaaccaccaactatatcaaatggtggtggaccagtggtgtccacttatagaacattaacaaacatcttagatgaactgtataacatcatacaataacaattgcaagaggtgaaaaaaggatccatgcaaataaaagaagcccagcctgcttctggaagtttcaaacccttaaactaaaatgtcgtcaaaggcttataatgaaaagtttgaatgacatcagtgaattttttatactaagtccatcaggatatgagcataataatcacactcgagaagccactcatgcaccatggctaacattatgacaaacttgacagaaggaaatcaaaattatatgccataaaaagtagtcaaatggcttaaaatcaattatttaaacatgaatttgacaagtctcaccacccaaaaaatggtagtaaaatcacatgatggataaatgaaaaacaattacctcaatcacggtattcaagtaatccagaattgctggaattttggcttcagctgagtcattatagatctgttgattacaaagagaaacaattaaaaatagaaaaaggttgagcatctgaaaagcaagtactagcaggctaagcagataatgattgcaaacatgaaatgatcgagtccttttttcatgctataaaaatatattcatatgcctattggtccatggacttctaaataaattcacatgatgttttaataaaaaaacctcaatggttgttgagggtccaaagatcaataagaatttatgcatgtaaagtagtatacagggttttcaatgaagtaatctaccttagaagtttaagaattaagcaactctagtgtatcaataataaggcttggagtgatagaacaatttcttattcatgacaactgaaatctgcaagtttcatgccatctatataaattcagctttttttggatcagagtacaatccatcaaagtttgaaaagcatcctcaccagctcatgatcagatgctggcctatttttaaagattcattggccaaaatggaaaacctacctccagagttacatgatggaaaacatgcagctagctaacataatacacaagtacaaagatgcatggccaaaagatttttaaattacttggacgttccatttttaagaatgccaaaaaaactgagagctcattcaataataagctcttagcctataccaaccatcctagataacaatggtcaccaaacggaacctagtacacactcaggacaccgatccacctagaagggggccatcctcataggtaatgcttggtacatacagtgggcattggtaccatacgttccatatttaagaatgccaaaaaaactgagagctcattcaatattaagctcttagcctataccaaccatcctagataacaatggtcaccagacgggacctagtacacacttaggacaccgatccacctaaaagggggccatcctcataggtaatgcttagtacatacagttggcattggtaccatactagtcatgctgactcatatgggtgcatatcgatagtaccatatcgggcacatcagtacacaagtttaggcatcccaatgcccatacttgtgccagtttcgcactaaaacattacaatacttgtcgcacgatccctcttcctagaagtatttaaaaccatgagtggtggtacctcattgggattgctgttcacagtcatgatactggaccttgtactagtaccatgtcggtacagtgttggtatgcacggttggacggtgagttcagtgtacagatatttgatacaccccctagatcgagtattggctcggtattagaaaagcatagcacgactagtacaaggcggtatgcacccacatgaagaaccttggttggtatggtgcgctcaatacaagagctatgtattagtacaaaaaaccttgatctgaagagtacgatgcatcacgtctccggcaaaaaaatattgccacaggtaaaaataaatgcacacaagtacatagagtacaaaccttgttgataagatttttttgagtaaattttagtgattcaatcttttcattggaatcacaggcttggatgttggccttgactacctccaactacaaaagaacatatcaacaccataagaatgcgaatgtaacaaatcaacagcaacttaaaattatactaaaataagaatgtctaacagatccttcccttctatgtagaaaggaatacgttgtaaatcattgacaacaataggttcctatcaagggcaatggttaatcaaaataagcttaatatgccttgcttgatttgttcccagccccaacccaattccaccacttgattagcaattcatcctcttactaacaaatatagggccctccttaacgtgaaattcctccaatcttcatccagatacgtaatctatatatcatattggtacaattactgaactcccattgatgtactcgtttctagttggaacaacaatacgaacactactacgatataaatggggaaagacattttaaggaataaaacattggtggaatgaaattggaatttgacaactgaaccaagaaggatttgacaccatctgaccagttgtatcacaaaagttagtagaaaagttcttgaagagtccaaagggaaaatatgtagttatgttcctattaaaggaacttggtgatgggatcaggtggtgaatgaagcaatcaagaataagtcaggtttaaatatttgaggcgaacaaaagacacagatgaagaactttaaaaattacatatggaaaagagctgataatgctcatttagcaacctatgattatctaaatgataagattggattgaacaagagggaaaggaaatttatcataacctaggaggaggactagaacactaagttagcatcggatacaaaaacatttgggccaatccaaggaagcccgaaatacaaataaccaaataagggagtaaaaaactgctcatgaataattgtcaaaagcataatggtgatggttgtgcccgtgagcataatcccactagtctgtctagttttttatggtatttgtacgggtaactagaagaaacaaatttttacacataaagagaagttaacatgaagtatagttgtccttgagttgaagagaaatgtgaatgaattacacagaacacaagataaaccttgaaggaaaataaattccaggaatgattatacctaagattttgcaaggataagaatagcaaataacattgtaaggattatttctaaaataattttttactacatattatttcttcttcaaaagaaaaatgaatgccaatcacaattagagatccatcgaattcatacacttataattaagcgcatcagaagtatggaaggcggaccaagagaattggtatgtaacttcaatttggcatgttagagtgttttccagtcatcaactatttatggtggtgaataaacaatatactatgaactaccaaattgaaaaggttgtcctagagaacatgtccatatacttgcagtttcaactatctcatataaaatcatttgcatgtctttgtgatccattttcaaattccaatatctcactttactgaaaaactcagaatgtggaagataagccatgtgttacgagtcaaatgtgtattctgtatattcttttataataaagcaggaggtgaagtaatacattagtgagactggagctagtttccagcaaactttcaaatgatcatgtttatatttttacacttcatcaactttgtcaggaagtatgagcgtagttgtgcccaaaaaactccgtttaaaacagtattaattaataaatcattgcctgtctgattgtagcctgttctgaagtttatgagaacatatttaagctttccaatggcagagtatttttccagataacgtcaccggaacaatgtcatgcttcaaattttgaactgtcatacaatttataattgcaaagtaagaactcaatatagaaatctgtagcatacatctcataatacactagaatgatgcataatcatttgaggacaaaattgttgcaagtaataaaacaaaattaaaagagtacttgaaaggattacctcacaaataaaaccctgatttgtttcatatctttctcattcaaatctaggaagatctgaaaagattggcaaagaatattactgacaacctcatgaaccatattataataaagtgaagaaatttcttgctaattgcagcatcttcaatccacaaaaccatccgccacagtatgctaaaaagatgcagaaacagtccttacagcatgcatgcttggggaaattgctaggacgtagtagtcagtgtttcggtgtgcttttgcactcatgtacatgtgaatgtgttggtcataaaatttatgaaaattatcaaacagctttctaatacatgagatgggcctcaacatgatcaataacttgaaacagaagtaactttccaatagaaaatgttgaaataatatactgatctgaactaattctaagtcatcatgaccaacgttggcatatgtattaaatcaaaattaaatgatttgttctgacaagccaactcaacttgacaccaggaataagctaaaatcagactaagagatgcaaaccttcccaagcttcacttgcatatgctctgtaaattcgatatgaggttcacttgaatgattcaatctcaccaatcatctctatgcagagttgcatcctccaacagtccaactaagtttctgataaatcactgactgcttccatgcaaacattcttctatctctcaagattcttctcaattatttaaccaaagcccaagcaaatctagatcgagactgtcttcaccttccattcaagataagcaaaaccacctctaatggtccccagtcatcttatcctcctctacaaattgctaacttgaaaacctccttccaagtacccaacttaaaatttgtcctatgttctaccatacataaatccctgaattgccatctgtagtattgtcatcttaagcacaaaaccttactttccccagcattgccattcatatgttgcagaaatcataaaacttttgttaaacaacagtttgatctaactggtatgtgttatcacacaaactaaaatagctccaccatcttcttaggagaagtgctcacaaccacatgaagacaatgttagttgttgttgttgcatgatcagcaccaattttaaatcctaatcctaaactaaatgccatagtagagttgttttcctataacatgaccgctggggttgggctttttggggtggggggggtcgtgggggtggtgtgggggttgtgtagcaagctgaaccaccataagcagattcattctcgtcaatcctagaccaccgctccattggaagagctctattgccaaaattcaacgaccggtaagcaaacccagaagagagacctccactgttgagtctgatagatggacaccatagagaaaatgacagtcttttcaatgagcaaaaccaacaagttcaagcgaaagtttgtcacagcatcgggaaacaaaggaaaagaagaacatagaaattatatttaacaacctgacatattgctagaaacacacacacacacacacacatatacatatatatgtatatatacacatatacatatatatgtatacatatatatacacacagatatatacatatatatagatatagatatagatatacatacatacatacatacatacatacatacatatatatatatatgaggtgggggggattgggctacactcgagtagatctccactcaaatttggccaggtctagatatgatgatgggggttccacatcgatgatttaagccgttagatgtgatctgatctactatctctaaattgtttacgcatcaaaaatcatgtgatttgaaaacaactagcctatgaatcgagtggtccaaaaatggatagtctaaataacactaaattatatatgttttttttaatcacttgatgcataggctaggggctccaaatcacatgatttctagtatgcaagcagtttaaagctagtagatcacatccaatctccaaatcacttgatgcttaatcgaacttcccaatttctagccagttcggttcaccatgcaaccattcagtttggaaccattcaacatatcctggttttaggtcttcctcatgaatatttttatcaaccatcatgaacctaagttaaatttcatgttcttaaacctaaaagtaaatctaaccgagattttgttttgaaatccccaaaaatcctattcagtttcgaagcttatggcttctttgtggtttatcaattctggtttgaagctcatgtgttgtcttcaaaagatttaaacctcaaaactttctcaaactttgggtttcttttgaaagtttggattatatataccaattttaaagtcatattggaatttgaaactgatgatttgttccaaagactcttggttgtttctttctttgaaaacttgtcatcatgtaaattgtatagttgtgttttggtatctgatacggaaattataagtttatatgagattttgaattggtattttagaatttgaacatgtgcatcatgacttgaatttttatcctgcttttgaactccaacatcaattttttcaactgtaaaatattataagtgttaggtaaagcatttggaaaatttttaatataataaaagtgaaagacttatgcgaacccctagcaaagtgttatatcagcctcattcaaaatattgatgaggtttcttcaaacccttcactaggtatatgcagcctcattcataatagcaattgggattggtacagacctttgaccaagcagtatatgtggatctcaagactttatgtggccccatctgcattagcagggaggattttatatggcctcatccagtttactggttcaccagtgactattatatggcctcatctagtttatcggggaggatttcatgtggcctcatctacagcaaggatttatgtgggcttgaggtataaaggaaacttcaaaataaggtatgaaatataagagcatttcgaaatataaattatgctttgatcatttgattttgtgtaactatcttgcttctaattttgtgtaaaattatttaaactcttttccaaagttgagtttgaacatcaaaaactttgcttttgagatttcataacaaaataatttcagtgaatttctgctcaagcttttcattgataatttgatcatgtgtgccaccttcaagtcatttgttttcgcatggacccttaagttcttttgatcatgctaggagtttgcatactaagcttcatagcttacttcatttattacacaattttccagagtgattagtgagagtgagatctctagtcgatatatttgaataaatggattcaatatttttgggatgctgacatttggatctaacgatcattgaaactatgttggtgatgtctctgcttatacctttaaagatatcatattttatagtgcaagttatgttcaaggttgtaaattgatttctaatacagatattatgagataatatactcttagtcataccttgttgaatcatgtaggttttattaaggatgttaaatatttacaatgctttaatcaacttctattgagaatgattaagtttgaatttttgtttgtttcattttggtggtcacacttcaaggtttgagcaacttcagatccaagtcatgataataagtgtgccagtataccatatgagagcctttctattctcaagcctatctccatatacttctataatatgaacgaaggttcacagtctcggtatcggaccccatataggcaaaattctactataatgtgagtatacagtatggtacgactgtatcaatatagggcggttcagtgtaccaatatgatatgatacgccccatacagtatgacgaacgctgatatgaactatgtaagtacaaaatcccctattctagagtgcccctatggtgtttaaatcttaagttctctcaattacccttacaatatttcatattaaattaagctcccatccccaattaccatatacaaaactaatcttttttttttgtgaaacactccaacctaatcctaattgaagcaagacttcttcttaactgaagaatagtatcttttgtgagtaaattgattggccctcaaggactctaaaatggatctctaaatcagttgttcgagggaaagataattataagggtgcatgcttagttgggagtggtagactcaaagttagggctgaaatctgatcggatacagattggatatcagtatatcaatatctatatgtcttttgtttggcgaatacaaatacaaatacagatactagtcggatacaaaatttcatattcatatttgttttaaacagatacatatacaatcggatactagagtatgggtataaatatggatatactaaactttatgaccatagaataaaagatattactaagtggatgataaattaagttaataacatattgatatggctatatatcttccttaaaaattcatgaatacgatataaaattaaatatggttacaagtacaattggatttttggatgcgtattggatgactgtcgatccatgtccatatccattttctttggcggatatggatacagaaatggctattaatcggattttcaaatttctatctatatccgaatagatacagatacgaaaatagatccgaacggataatatccggtccactttcaccactattcaaagtatgttgaagtggccacttctgcgcctttgccttgataaaattgggctctaattgagcgcatgattagggaccatagacatctcgagcttgtaccaagctagggcctcagctccactaaccttgggctcaatcctttgacatcaatcatatctatccctcctgatcgatatacgacccaacccaacatgattgccacccctaagctccacaagttgtgaaactaggaaataagacttggggttttatatggtcaacgaagcaaaggcgacaatgctagagctcaaagcaattggaactgactaaaatgctcaaacattctatagtgaagctggagaaggtgtggataggtcttcatgcttaaccaacaggtttgggatgagaagggaaagatttataatatgtggaagaatgtaataaagaagtaacttggaagcttaatcaacaaaggaacactaagtggaaaatatgcatcagattaggctcatgagatcattttgaaagatgcaaaagggctcaaaaaatattgctatggctaaactgatgtagaacttagaagcatatatcaaaaacaatctcccactcccatcctcttgactatgtggacctgttagagatttaaaaagaaaacattacttttataactctccgatatcaaacacatccaactcagaaaaggctggtaatctatggctatggctatggtcagggtaagccacagaaatgcaggtcaataatattacatatcaaaatcactgaaaaaagaaacacatctcctacaattgttttgactatgacaatccagtaaccattagaaaaaatgttattctcaagctcactgctaatatgcatccaagttcttgttcttgtttccaggttcttggcagttagcttcagtcacataagcaaaaaagaatatgtaatgtgggtagtgtaaggcgattgagcattcaaaaatctatctcaagcttggaagcatgccaacatggtcaactcttcatgaaaatgaaagaacctatacaaaataataactaaaaaaagactaagtattaccagcagaccgacatcttttctggtaatataaaccattttaatccgaggttgagtaaagacttttactggtaggcaacaccatgtccattattacagtctgaggaaatgtacaatagatatggacagtaactgatggaataaattgcaggtcagtggtcaatggaataccaaacaagttggaaggctggagacaattgaacccaataagagtccacattccaccccaagttgcaacataagtaatgagagacaataagtactaaaatcttacctgctgtctacgcttcactggtagttgtgaaagaacatctttttttaacctacgtatcataacagttgctttcatcaaattatgcagctcttcatggttgcttgcaccttggtacaacccaaaaaaaccctagaaaataaattatataatcatcaagtgattaatctccaatcaaactgccacaaagtcatacatgaacataggaaataaatacttacacccctacaataccgattcccatactcatgaacatttttgtacacatcaggatacaatgcctcgagctggatttaaatgattgttagcctagagtttcatatgtgcacgctaaaaaattatcataataaatacaacagcaagctagctccactatatcaggaagagtagcacctgtttgaacaactcaataggtcgcgataaagcaggagtcccactcagcagaattgcatattgagccttctgtaattgtatcaaattgcaactatgtacaattatatcaatgataaatttatgggtattgaatgacagaggggctgctgtcagttaacaaaagttacacattctaaaaaagaaaaaaagaagattaaaaattgtaaaagtggttgtgtgtaaaacaatgtacaatagcagaagagacagtccctgttttaagaagttgacaatcacaatggtacacagaacatcaactggatgagtcaaggatcgcgatttactcggactctcaagactggggaaacacaaaaatgtttaaatttgtatgaccatgagaggtatatttgtccacgacatagagcgctaccagttgacaaatattcagcttatttatatttatagcactactctgtagattaataaacgtggacccttagaaccatcatttttagcaagtcttctgatcaagtcagtctcatcacgacaataaaatctgtggaagttatagtggaaactggaaacaaataaagtaccaaagattcttgaaatgtacatgcttgcccagctttctaaaccaagcatgttcaatttatgtttatacatacaactggcctgggtgcaaagtatcacagaaacggaagcaactaaaaattcatgaacatcattttgttatgttaaaatatgtatttacatataaaatatagataaccaaatccaatataaggatggtataaaaagtatcaactgacttcaataatcagctattaaactcaaatttgtgggaagcaccaaggttgttactaggaaacaagtgagcacatgatggctgaaccaaaagcaaggaatgggtgataaagttgccttcacaaagagagtgggaagtgggaacaacattagagaacttgagagaaatagatagcaagtcactatgcatattgagcctatgccatacttcatcaggttaagctcgagatgatgtgatgagcggattaaggcttccaagtctcagcttgaagttttgcacccaaatttggttttagttaggtataagccaacctcagcctaaaccaagttggtgcatgtaataataaagtatgtacatacaaatagtatgatgttatacgatatagtacatagtattaaagaaaccttaaatttaatctcctcctcacttctccagatacccttcctctccctctcctcttctcccggcctttcttcaccattcctggacaagctacccattctccaaggtagagtcaattaacacaattctaactgcacattgactttggacaatccttgacaactgtaactttccactaatgcctcatccattcttaatcaatccctaaaatatagaaagaaagaggtgttctcagatatttatttgccaagaaattcaaacctgcagaactggcagggaagcatttgttctcttagcttgagcattcttcaaaaaatgagactcatccgcaattacaatctgaaagaagaccatcacaacttcagccattactggttcctagaagatatcatttaaaataagaaatgatgtgaagacaaagtaaaatctgtggtcaacaagaaaagtaaaataaaatttcagtatcaaatgagcgtcaagttcaacattgaaccacataaaaagaaagtatggagaataaaaccagctggagagttccaactgaaagtaactgactttaatgatatgatggcacataaaagaaccacacaaatggctccattttcatttcataattttcagcaagctcccttggtcaacttgttagccaagaaggttacacttccaaagtcacatccgatgccttctgaaaaagatttgggaaacgtttgcaaaacattaagaggtagcctaaattggaaaggttggaaaatgaggattcataacaaccacaaatagttgagacagagcttgaggattcaccatcaccaagaaatctataagcattaattctagaaatccgaccatgggtattaggataacattcaacatcctgctattacaaagtgcaagcaatcttgttttggtgaaattttttacttttttcaaaagcatgcccatcctctgatttgctctttttccacccgacaactaaaagcgggccaacatcacttaagtacaccttatttttttggtgtgtgcaaatgaagccacataaggttctgtagaacacaaaatccttccaccttaaacaccctacacagaagtgacaaatcacatcctttgtttctgtatgcccattgcccattcatcggtacatgcacgtacaataccacatgcttgagttccttccacaaccccatcatgacctctttcatctgtcattatgtttagctttctccgatcaccatcagaaaagccaaaaatccttttccaaaaacatccttgacacgagtagaaaataatccaaacagcataataaggttggcttgccacaaagcctgcttctaaatctagtctgtgtatgttgacttccctttcccaaacactaagatctacagttgcatgataacaaaaccaccacagagatccaagtcaacccagaaaatcaaagcaatatttgacatcacacagctacgtgtcatgtcttccaagagaataactacacaccctccttggttgaatagtcacgacagggacaacattagtcccaatggtttcccgcaactaattagacctccccaaaggccctggttccttcagcatgtttctccatgttcttgatttccaactccgtggatctgaaagcttacatctcatggactttttagatgcaattatgcacaaattagcagcttccaggaaacagctaaaatcatattccaactgaaactgagtttctttttgacatgcaaatggattgcattccagaattctagaatcaaagccaccaccttaaaaccctcacttaaaataaataaataaataaataaactgtgctatctcttaggatgtataaagtggctggcatctggtatttagcgctttaattttcagtgtatgttttacctgcatattatactggtaacatttgttaatttgccacaaaataaatactggcaaaggtttctatccatctaatctcttttacaaagcaagaaatgtaaagataacctgatgaaaagagattatagaaaaagaaaggtcaaataatggaaattgtatgtaggaatttttcttttctttttaacatcaagttagacaaagttacccagaattacattctacacaagaagtatgatgaaaaaatgaaaacaaaaagggaaacaagaagaaatcttaaatgaaagagaaagtatatacagaaaggaatactctaattaccttaaactctgaagctaggagtatatcctgtatcttaggaactacatcatatgagattatgttgaaaacaccatccaaatgaattgctgcctttaggtttgagtagactatcttgaatcctgccctgtttgatcctccatattgagataagaccacctgtaaactcaacaacatggtataggctccctaaaaaccaaataacaatgaaaatgtgcaatgttgaacggcatgtgagagaatgcattgataacagcaggagcaattatgagtatgaacattctcaaactgccttctcagtgtccttgcttcgagcagaagtgcagaactatgaaatttctgcttccagatgcactataggcatcagaaacaatcagaacaagccaacttaattcaacacaaccacatttgtacccaaattcaaaccatgtgtacaaccagtcatccatgataacagcaaagatgtttgctattgcaacatgacaaggaattgacttacaatgactgacaactgcttcccagacattgacatcaagaatcttttccacttggttgggacgcacccatttcaaaatcagatttcagctcctctaacagcttgtttgcacttccatccattcaaattaacaatcatgtatctccaacaacagtttgttgaaattaatataattagtatagtaagtattacatataatatagtctcttaaaaactgctgacttccagttcaagcagttctattgaaatgtaattgtcaaatgagtaaacttcttgctgcaatacttctaatcctcaaaagactggactctgtatcaactgccatttttaaaccaatcacttggaaaaggaaatcaaatttacatggttgagtgcaaaataatcgttcatttaaaaaatcatcatatttacattttcacagtagctttcattgcaggatatagtccacgaattggtattgacaggatcagtcaacagaaaatgaaagtgaagcacatttaatgccagattgactagtttgttgaactgatagatgaagcacgggaaaatcatgaagttttttgaagactcaaaaaatagaggatacaaaatggtataattagaaaatcatgcaaagatatcatcccataatatagaatagttaaaatgaaattaagtaattaagcttattcatatgctttccatgcaaaataataataataatattcagcaactccagcttcttagtaagttaagaaaatctgacagaacaatcaagtcctgaagtagaacagagatataagaatagaataaaaactgtgtattccagccagctgttctgaaagtaacttacagaactaggattttcacatgctgctatggtgcataccagcagaatcatcaacaatcacttttaaaatcaacaactgcaaagataagcctctaaaacatgcacagaaatccaaattaaggaaaaaaaaactgatattctgactcttacgatgagaacaaacttaatcatcagcagaatcagataatcatgcaagtgaagaaccacagataaaatggacagcaacaaaaacaaagggtgttctaatcaagtgctgactaccaagaatgatatgagatccaatagaataagaaagtttacgggttacataataagaacaaaacttccactgctcaacaaagcctatcatatatgttaacagttaaatgctattatttatgcaaaacaaaatttacagcacagaatgagaatccaggtttgaaaatcaaacgggaaaaaaaaatagggaaaaggaagtcaagtactaccagtatatctgatgaagggatgttaagccactcccggatcatctgcaagacaatttattaattgccaaagtaacaaaaattccattttgcaaatttaatttggtctaatacaagcattgacaaagagtgggatgatgttactaacagaagcccactgtaaacgcaaggaagatggggtgataacaagaacaggcccgtcatcgtgcatgcatgcagccacagcaattgcctgcacagagaagtgatatttttttagaaatataaagatgatttttttttcatattggatcacggtgatgtttactgttagaaatagaaacgatccacaatataaatgtgagactgcattttacccaagaaaccatctataagagtaggacttgggaaaatgattgtcgatatagacatgcaattatgctgattaacttcaaagttaaattacgaggaccaagaaaaacccaagttgttagaaaggatatagagaaacctgaatcacaaagataaactcatgttacaattataagcccacctcgagactcataaaaattgaatgagttctagcaaagaaagaaccacaaaatgatccttttttgcttctaagcatacagccgagaaccataatcaaaggagggtaatatgcatccgtaagaatgagaaagcttccatggttccaccaaaaccatcgaggttttcacatttgtcagacaaataccacatgaaagaagcacaatttttttagaggccctacaaaaaccactcttttgactcctaatgcacagttaaagatcttcggctttgttcggaaatgatgaaatctgcacaaaaagggttgacatggagctgaaaggaagtcaacactgatggtttgccagtatccaattttgaaaaaggccaataaaaatagttataggaactgcaaacttaatagtgaccttgaagttaaaatctaagagttttaagaaaataaatattctaagttagtgcatatgaactgatcaaaagtgtggtgctgcaaatgcctgtaagcctcttcgagaaaacaaagtcttccctgttccttgtgaagtaacccttgactctctcttatccggaggcaagatcattttacctgcaatgtcttcccaagacccatctcatctgctaaaagagctcgtccaccatgctgcaacacaaacctaaaacatagataattttgagaattagatatcaacttcaaagggaccaaaggtgaatattgaatgcttgcatgcagtacaacagttattatactaccataaaatcctaaagagggcttcctgtacaactttatccaagcaaacccaaggttataatgtatttctatatgcccttgtgaaacttttcattccctacatggtgatcgaatggagatcatgctataaactgagatgcttcctgttcgataacaactgaaatcagccatgacatgctgcactaacggtgggtgtgtgacacagtaaagtgttaatgcttagaggaactgctggcagtgttaggttgactcaacttgcatgtgataaagaatgaaagtttcaccatgcagaacaagcaagatttgaaacccttaacctttgcaatattgaagaatagcttagcatataatgtatattttcaccaaaaaaaaaaaaaatcttggcacagaatgattgcagaactaaaaaagtagatgcatttaacaaggtttgaataagcagatctgttgcttacataataaatttttagagatttataaatgttatgattgaagattttgaggagagaagaatcactaaataggctccacattggttcaaaggcaaatgtttaaaagcagactatttccaatctacggaaatattgtattgcaggggacatgaaatgaactacaactcaagtttaactgggtcagtgcaaggaaaaacatattttgcatcacatattattcaaaagataaagtattagttttctgatataaggatcacttccagtctaagccaccaagccttaaagctataatgggagatgatggaccaagaagcagctggttcacacccaatcaacaatttcaatatgtttttcaacttgaggactaatgctgttaaaaatattttgaacttacagaaggtttgtactttacagcagtgaaccagcaaggcggatccctcacaagtatcaaaattagcataaattcaaactcatatcaaatgcccaaaaattaattcaaaattttatttggaagtaactagaaatattgcttttctattttgaagatttttgttaacaagtctcgattctgataggactttttctatacattctactgaactgcaatataagggtaacttaatatctagcaagctgagatggaccagccatctttagatggcagccatgttgatcttaatgaacctagagatggggtgaagataaaagggcctcgaccatctgcaggaaagaaaaattaatttattttagtttagaagacttaccacttgaaggtcctgttttagttatgggtaccactgtgggtattctagagcgattagaactatgttttagattaatccagtgacctattctattttattttcttcaagccaacttagtcatggaatgctggatgatggattttgttgcaacatacaaggaatttgttgatataccacaattgcagaccatcacgcactctgattcaaactaaaagtgctttgcagaaaaatactccatttaagaagatactgctgtccatttaaatactcctttcaatgtagcacacctaacaaaaagtgcaatgcaaaaaaaatccttgatttatcaaacctcacaaccttaatcagatatacacctcaatattcatctaaataatagtttcttaacaaatcaaaagaagagcaagcatgcttcatacctaactccttctctctggaatggcaggagttttgattcgatataacttggcatcctgtcatataaaacttcccggaagactattgagttagtaaccaaaacgattgaaaaaaaaaaattacaataattatacaaaactaagttaagaagatggatgtcattcaggtttcactcaataatatacaaaaaattgtctagagatattcatgaaacaaatctgatcctgtatgtatccaaaaaaaaaaaacacctagaactgcaagtttctaccagtcacatgtcatatcatcaaaaaaacaacagataggaggaaaacataatgactagccaattttagtgtgagaaaaagaaaattttcttagttatttgattaacaaaaaatgtaggagaaaaggtcaccaggatcagttatgagctatcattcaaagttctaatttacttcttatgcctcttcacatgcttgccaaaagaaaatgaggtgaagaatggacaagcaataaaatgtcatagaaaaaagccatgcttaaacatgatacaaacattagttataatccactcataagtagtaaaatgaaagacctatgtcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatctggaacagaatttcaattaaatataagctccatgatactacaggttactatttgtttgtccattggatgtaaaatgcattatcgataccatgatatataaatggcatttgtttctcgttcattaattgtttttgttggttaaaggtacaaggacaaaatagctgaacctgcagcacatgacattccaaaatacaaagatgttacctcgataattgcaccattcactgaattaagaacttcttcagcggtcgccagggaagatggagggaacatccacagcctatggttttaaaatgacaagggaaagaaaaaaggaaaaggagttaatagtgtcatacaacctagagtgcaaaactaaacttcgaactatatcatagatgggcacaacctttcttttccatgccagctagctttaggaatcttgtgaaaagcctctacgactacctgggaaatcaatgatgcatacaagaaaaatgtcacagagatgccaccaaagcagtgcagttagaacatttgacaagttagggcagaagcacaacctgatggtaaggaaactttgcagcaatggcgccactaacatgaagatacattctgacagagagcttaggcaggtcagcttcactatggttctcttgaaagacgcacaaaaaagtacacataacattgaaatcaccaacaataccatactagcaaaaaagtcagggaacacagtatgcttaaagaatcaagatagtagttcaacacatgaatatgtgaacagattgatataccagtttctttagacatatctgatgggcacaatcttgaaggagaacaggtttctacctacgccagtgtagaggtgttagaagacagaataaaggcaatacgtgcaaaattttaatctaaagtttacattactaatgccatgttctggagcactagtaattctaaaagttgttctctacataacaaatgctccaaatacaacaccaaatctattaaaatattaaaaacaagtagatgcaaagtgcactttgcaaaggaaaagttatagaattagattttctggtttatcaagatcaacaagagaagttaaataattaaaaaaaaaaagataaataatcaagaaaaaaggtagtattggtgcagtgcttgtagagaagatttagagataaaaggagatgaaaaagatgactagtttcatagaacacttagccccttttcttgcattcagtttttttcctgcttgcaggcctggtatcccaggttcctgtcattacatccgtttaggaatcttagcctggctgcaaaacaagccaaaactcttcctgcaaaagcaaggcaagttacttcctctatctacatgattgaactcttataacaacacaaaggcccatcattctagccaaccaacaagaaagatcactagtaaatcctgtatagaccaaggccaaaaaggcagcaactgttcagccatcaagaaatatcacagttaagtgtcctgtctagactaaaactaaaaagtagtgccaggcactgaaacccaatgctgtcaacagcgaaaggtgctcgccagaacaaagcaaggtgctggtttttgagaagttcaatgaacatagtaaaaataaataccatatgtacctttcaaaaaaaaaaatacaagcattataagatagttattcaaatttcaatatcaaaaatcataattgtcttgtacagtagacatcgtgtttcacaactttcagaacaccatatcaaaataccacttgccaaatgcctcttgcttcgtctcaagtgctcgcctaggcatcacctcagtaaagtccccatgcatggggactattgagacacttaggagcttccccgcatcgcttgagcacctaggcaagcacccgaagtgcctttaacaacattgcttaaaccaataaaagaatgatcacatagttgttaaaggctcaatatccactaaggcgctgaggtctcctagagcctagatgcaagatgcaacagaagactcctgcctttataaagtaatgtgcaaaaacatcaagatacatataaaataattatgaatacatgattctaaacacattttacaatgaataatcaacacatgaacataaatatagataaagaaaaattaggggatggggtggagaagaagaggaggaggagaaggaggaggcccggttgatctttctttttggggcaggaatccccagaaacctggtcaaaatcaaaaggctatgattgaaatagtaaacatgtgctttctgtacgcaggcttttattcaaggtgcaaaaaaggcaccaacattgaggtgagtgaggcactcgaggtgcgcttcacttgtgtctggcagctggattatcataaattaggatgagaaaagaacgacaaaacagccaaaactctatgggtgaaaccgatcaagaacccgactcatttgttttcggatatgcaagcattgtaactcacttaaaaaaaaatctcatcttgatgcttctggagaacaagaaatcactttcttttcacgaatcaaacacaaaacctaggaatttcaagaatgggtgcgtaattgaacactccagagtccagacaaatccaacagaagaacccaagcgacaacctttttatagcgcgactccaagaaggttttcgagggaggctgctggaaacccttatgaggggaatgatcggggtcggtggtccgagacggaaggggggaagaggaggcggaggcggcggcggaggaggctttcctctcggagatcttcctcttggcgtcctcctcaaggaagtcgagttgttcggcgcttagaccccaatcgtcaaagccctccatcggactcccggaaccctcactcaccgagttggaagcgggaaggatgagaggaggaaaagagggggatcctggagtttttttggaggggagttggttctttttaaaagcaccgggacgggacgcttgttgccctgagaaattgttgcctacactgcgtgcatccagcgtggccgtatcacggccgctgattttcgtgatagttcattgagtgtaataccgatgacggatgccatcgtgagagatgatcaagaacactggcattggtcgcattttgcttcgcttttgcctttttggcgttgctgagacgtacgaatgctcggattatcggatgtggtttagatggagaaaatatttttaatctcatattaattataagtcaaaaaatatataatttatataaattaaaaaaaattatatataatattttttaaaaataagatcatacaattcttatcttccaattggagaatctctgtacaccgcattgtgcttccatatgcacatgaaaaatagacgatccaatcgatagatatcctccatctatctcctctatattttttttattttttatttttttcttttttttctttttcttttattttttatttttttctttcattttttctattttttttcttcctctttttttcttttcttttcctttgtttcttttaattttttttcctttcatttttttctttatcttttctttcttttttttttcttcttctctcgctgtgtaaatgagttttaaaatttcgaccctattttcattccattttctcaaataaaaccttagtacctagcatagccagtaatgaacaataacgagcattcatagtataatggtaattttttttattttaacaataaaattttagaaaaatgtcacttttacacccccacccccaaacaaccatataatagcaatatttgtgggtagtgaggccatttggcaattgacataattttttgataaaaggaattaccaaaagatcaatatacctttaccaatgatcataaacgactagtttataaggatattttaggaagcacaatagtttctaacaatctaaataagggttcgatctcaccatttctaccacaccaattcattctcttaatcctctcttactctcaatttttttttctctacaaactcttcctatttacttgcttacttataatcaattttgctcaagtatgcttgaattatctcgaagttgaaggatcaaactactagtgtcaactaccaaatgctctcatcctctatcttcggtgaagggtacatacttctcaacttaatatttctattttcgcttctagttattagtataaatagatcttgttatgatagcacctctagtatgacccccaatgaagagacgaatactcctcacaaaatcactagtgcttatgtctataagattagaaagaaaactaatgagatatggagagattttaatcaatctagcaatgcctaagatgaacctacaatggtttgcaaaaaatataaagctatcctgatccctaaatcatctagtggcactagccacttgaaacaccatatagaacaatataggatacatgatgcaaaaatctaagcccacttgaatttagttgggggtagttttagttattggcaatatagtcaagaaatacaacgtagagagcttgctaggtaaataattcacaaagaaaaaaatatttataagagccgagtcaaaaaaattatagcgatatatccaacagagtctacaacctagatatagatgaattagtaggaaaataattcatagataagcaatgaagcaatatattgaaatgagagttggatttcaaaaattattaggattcttagatggtaaagtgtcaatgacctgtgttatctggattgctaactatcgatgttctagttatatttgttgcactatacattttatagataatgaatggaatatgaataaaataattttgagttttaagctatttaaacttttacatattgcacctataatttcaaatgctataaaggcaactacaatatattatggcattcaaaataagatattatccattgcttttgataatacatctaataatactgctggtgtttctttaatgaaacaattattaaatttaattttggatggtgattgtttacatattagatgtctatgatatatgctcaacctatgtgtgcaagatagattaggtattttaaatcgcttgatcactcaaattaggaatgccatctaattcaccagtatttttcttcgagaaaataagatttcaagcaactatgcaactctcacgataagatatataaaaaatttaaacttgatgttgtgcataagtgaaattctacatatcttatattaagtgatgcatttgaatattctgagtggataaaaatttttgtaaattctcaaataccttttgaggattagtgtgttaccaaaattttataatatctgttagaaatattttttaacataataatttttttctctgatttatatcatcccactttttataaatttttgacatatattattcagattgttgaaaaattttctatatatagaaatgatgaaactttagccccactagttcgatgccaagtggcgagaatattggcttaggttaagtatcatacactctattattgctatttttgatcctagaattaaattaactggtattctttatttacttgatgaacatcaccaatacatgctaaccaattcaattagtgataaagaggcagttgaacattatttgcatgccatgtgtagtttgtatgatgtcaggtttggaggcaataaaactggcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaacgaatctacaatatctcttatcaagacaggatttcaataattgtaatttgtaaacatatcaaatttcattttttagtatgaataaaaattatgatgcatttttttaaatattttttttgaatttttacattctctgtaattcgaataacaagtaattcaattcttaataaaaatttagagatattttttcataatattatatatatatatattttaattaaaataataataaattatgaaacttaaataactaacttgaataactaacgacctccttcttttcaattattgatttttttaattcacaatatgtttcatatcacttactatttagcctttaatatttcaattaatcaataataaattcttaaacttaaaaaaataaacattaacctaaaaatcttatttttaaaaaatttaatattaaataaaaaaaatcgaaaacaggcctgacgggcttgacatggcctgtatatatacgtgccttggaccttgccgagagggtcttgcttaacgggccgggccaggcccaactcatttatccacgttcccagtgaggcatggccgtttacttctgggctacctcccgtttatccacgttccgtgctaagtatggccgtttaggtctgagctacctctattccttagcgagccatttgtttatgtttctttaaacctcagttgctctcatgaaaaatagaaaggtaatcagtgcggttcgaggtcgaaccataggttggttcggaaaataaagaatttttcaccaccaccctctctgtcacccatccactgttgccaacaaccactcagggtcatagggttaannnnnnnnnnnnnnnnnnnnnnnnnnnnnnttaataataaatattttatcatctacaatcataatttagtagatttgagtaaataatgatcattattttgattataataataagtaatgatgtagtatttaaaaataaaatactgatcatatctcaagaggttgcacgatgaattgaccacctcatgggtaggatgacagcatcttttgcactgcattcaaccaaatagaaaaattataattactgcagttgctgccacatcaaaccaaatgggagtaattctagttgcaagcaactcacttgcatgtactgccatcttcaattgcaaggttccaaaaagctcctaatgtaactttgtttatagattaatcttggagatattttccaagccaacacatcaaaactcattttacaccttttttttgagcacattttaggtccacgtaacatctcatcttgtcggtgcgttagtgaagagaaaaggaccttttctccacatgctatcaaaagaattagaaagttttacgaaccataatttgctcaagtttggtgtggtccagcgaaataagtgcatgttgttttatccagatatgcaccaaaacataactagagatcagaaactgtcacgaaagctttggagatgttatgttgcatcacaaatggcagttgtaacatcgaacactaattggctcatagccactacgatgaccattatatatggtgagaacaaaatccactatttgatattttctttagttgttcatcaactcagaatgctgcccttgcaaatccaaggcacaatgttagtattgttgtgcattatttttaatatttagcagcaacaattgctatagtagatattatatcatgtcaaacaaaaatcgcttagaggtccatgcaaaataaaaaggggcgaaaagtggtcgataatcacattaaccggatgatgcgcgtgcttcatccataatggttgtttgataaactagacttgctcgatcatgtgatgacacatccataagattgattgataagaaatgctgctaaacaggaatttgaaatgtttctagagacgtagccctgaataatgatcagctgatcctggaagtggacttgggccatcgatcagattcatacggggcctgggcctgggcctccacactgtactctcaccttcgagggctcatgggtgacgggtcttttgattcttttcaaacggcagaggccagcagcagtggctgcaatacgacgctgacagatctttctcacactgacgcattcacggcctcctttttgggtctccattaatctcgctgtgcgaatgcaagatgcctatccgacggccaagcctgcgtcgaactgccgagttgttcgacgagcgtttcggacctaccggaatcctattaaaaaaagaagtggggtccaccaggtgatgcttcgccattctccgagacccaggattttgttttgcggtcgttttacgacatacgtggtcaagataacattattattataattagcgtagcccatttaagtctcaactgctgacgtctgataaggttggatttctcgctgctcgttgctttttccaccctttattgttgggttacctttgcctctcttcttacacttccctcagttctggctctcatctctccgaagcttagttagcaaggtatgatcttgttacgttgtcccacttttttcttggtataatttgttcagattttatctcgtatctctccaagcatgtagggatttttggtcaggcataaagccagacccacaagttttttcattactcagtcggatatttgaggactttgtttctaagcatatgggggtttctttctttttcagtgtttccatctcttactctctctgctaagtacgctctgtgaccttctcttctctttatttcttttttaattgcttttttcttaaaaatttttattttagtggttttctggtgataattttgaacatgtgatcacttgtagtttggttctctagacgttattgcttgtccgaagatttaagatccctgtggatgttttcttttatgttctcgaaaaaaatatggggatagtcttcagtttttcacatcttgtatgtaatggttttgttggtgtacttgttcaatttctgcttgatactttgaggtgggccctttaaatatcactattgttctttgatgatttatattatccaattaattgagtaaattattcattttaatttttatattttaagaaaaccatcaaaccgttcctgtactagtcgtttgtatatggatcttttatgcgcatgaccatatagcagtctacaggcggaatttctttatgtgcctttttagataattaagtaaacttttaggtttttcaaggttttatggtcttttcttggattttgacaccattttttttttccccaatcacataatcggttcaagctacatgtactttcttagcttgccagtgtgatatcttggtagatgatacttggccatgggggtaactacttaccttacataaatatcataataacgacggtaacatagcaatattacttgtgatctagtgctccttgtgattctcaaaggtctctttagaagttgtgcctgtcactaaaatagtctaacatagatcgagacatcactattatatgcttatttttcttgattactcatatctcagaactgttttaaaatttttattttcctagattgtgcttttttcctttttttttataactgttattcttattttgcacacaaggtaggcttttagcactgttaaaactatatatatattttttaattctttttgatatggtttcttttccttttgctaaagtatgtcttccaatgttctcgacttttccttgactagcttagacttcctgtgggtcaagatttgcatggactaaatgtatgactgttaatagattgcatcagtaattttttaatcttaatttggagcttcaaatatcttgtgtagcttgttccttctctcttctaattttctattttgagacatgggctgcaccccaggattcatttcaagcaatgagaaatgagtacataataaatgacagcagatagcaccaaaagttgcttttgatttgaagatcaagtggattctcttttctacttttcatgttattgatgttttaatgcaacaattccctatttctgtggcatgtgggttgctacttttctttcttttgttgaatcctttatctcatatatgtaagatctcatttcttagttgcatgcaactcatgttttgctgttttcctgcaggtgctttattaaaaatggggcatagttttgttctgttgtatatctgtttgtggactttgacatgctccttgcttctccatgcttcgtccgatgggttactaagaattggtctaaagaaaaaacacttagatgttgaaaccctcaatgcagcaaaaagtgcaaggaaagtgatcacccatatgcaaaagaatggtcttcatcgtagtctggctgactctgatgtagatatagtatctttgaagaactatatggatgctcaatactttggagagattggtattggcacacctccacaaaatttcactgtcatatttgatactggaagttccaatttgtgggtcccatcatcaaagtgctacttttctgtaagattctaggttctcatcatatagttgtctttcttgatgcaaatggatagaaacacattaatttgaaaatgtaaatccttgcagattgcctgttacttccatcataggtataaagcaagctcatcaacaacttacacaaagaatggtatgaccacttgttctgaatttatgagaatctagatattattgaaaactacatgagatctgataagcagttgcctttgctttattattattattatttttaaatatacttagttatgattggattttagaagtactctatatgctcttcctgtttacatcaatcatttggtcaaatacaatgtaacatggtgaattcattggacaacttttcattttccattgctgattttttaaatgcaatcgattgtttggtgtcaccacatctctgtttctaagcgtactatattgcttcctagaatttgacttgctagattagaagtcctgcttaatctagaatttgtgtgtctagtttcagttttaaatcatctacgaccacattttagataaaatatccacaaattaattcttagtcatatatgttctgatttgttaaaagttgtctatttgagggttccagggttcattggttcatttgatacttttcccgtccctcctttctccagattccttgttggccaatccttgctgcttgttttagaatgaaaacttcaacatttaaatcttttttttttgtcttaacaggagaatcatgtgaaattacttatggttccggagcaatttctggtttctttagccaagatcatatacaagttggagacctcaccattaaagatcaagttagtttttttgtttttttttgtttttaaattattttaaattaccttcaactctgccatttcaggtattgatgctttgtaggtttgatcttagtcccacatattgaacgagagacatttatcatatttcaggttttcattgagacaacacgagagtcgagcctcacatttattttggcaaagtttgatggcattcttggtcttggctttcctgaaatttctgttggtggttgtccgccactttggtatattatttctcccttatattagtttacttggattatatccttgaaatattttaccttatcattctttgaatccatatgtattacggtggtatgttctatgtgatgttgccaaacctcaggctttcttttatatctcatcacaggtatagcatggttgagcaggatttaattgacaacaaggtattctcgttctggctaaacagagatgcagacagtacgaatgggggtgagattgtttttggaggtgttgatccaagacatttcaagggagaacatacctatgttccagtaactcgtgagggatactggcaggtaatcccaagcagacaaagttgtgtagagaatgaacctagatccctttatatgcttgcgagttgcgtcaactcacatattttcactcatgacctctttttttccctttcttttttttttcagtttaacatgggagatttcctgattgatggccaatcaactggtaatactttcctctgtttatacatgcactgctgtcatatcatggaacatgatttttctgaacaagacttcgaaaactttttgtcatgtaggctattgtgctgaaggctgtgctgccattgtagattctggaacttccttgcttgcagggcctactgtatgttccttcaagcttgtaaaaatgattaagtgtttccaatagatgattttgttggcttttgtagatgctatattttccttctttcacaagatatctcagaagttctttaatttccctggttatttccatgttatcaccaatagtcactgcattatgcggggataatcttgtcttgaagatatatttctaggttgttgtgcagagctcatttcttttttctcttgctttaagataaagctatgatggataatcatgccaactaggtattttctttgcaaagatgctgtctttgtttgctatttcacctgatttttagccttcacattccagttgtctattcatggtctctttctgcaagatcaaattatagtttttctggctagtatctccttctttctcatgattattatgatttcctttctgttcctctttacttcatgtttgagtattccaaactcactatatctttttcctgttaacagtgttatggtgtgtcttatatgatacaatactaaaagggcctgtctgcttgggcacttggtctggtgctgaggcccacttcagcatccatactatggaaatacatatttttgccttttctagagttttggggattatttcttgttttggggcttccaagggctggcgagattgagaggtttgtattatcattaaagatagaacaacattatttatgcagggattagaaaaagtttaggactgggccctcttaaggactggggcttattgtctttctctgtataaggtacctggcagttataagcttgtaggtttcctttcccctttagttatatgtatgaacattgacagagttgtttacaatgttcaccttagagtctcatgcaagcattgcaattagctttagggcctgtttgcatgtatgggcccaaaatcgtatgggatttatggattgggcccagacaaccagctaaataagactggcttagacctataattataagaacccagaaagccgctcgagcaggcttgaccgaatcccatagggaggaaaaaaaaaagacctgctgtcatcatgtattacggtggtataattacggagttatgaatttcaattttcttaaatttttatatcttttaattataaattcttgtgagttagcttcagatgtcatcatgtgttatctaaaaacttttgctctagcgaaaaacatgattccattaattgaatacttctgatgctgttccacaatatccaactctgcgtctcgcaaaatgcagactgaggcaagaagagctggtagtaaaatcatccaagatgtgcaattcattactgcagttgtttaactgtgttgatttccttgcaaataacatagatcaaaatttatatttgatccttttaatcatttcagaccatagtcgcccaaataaatcacgccattggtgcagaaggagttgtgagcatggaatgtaaagaggtcattaaacagtatggagagttgatactggagttgttaattgcacaggtttgttctttgttttcctactcctttatcatagtaaaagtatggataactataatttctcctatagggttttcactgtcttcttattgtgatctgaatgtgtttgaatgactgcagactcgaccagatgaagtgtgcagcaaggttggtctgtgcatatttgatggagctcgatatgttaggttagtgaatcataatcattctccagttgcatgatagttgtgttatctttattttttattcaggtgttcattgtctctggtttcatttataactattgaaataagaaatataattccatgcagtgctggcattgattctgtggttgacaagcaaaaggaggaagatttatctcttaatcaagatcttttatgtactgcttgtgagatggctgttgtttggattgaaaatcagctcagaggaaataaaactaaggaacgaattttggcctatgccaatgaggtagtttgctttatagacagtaccattttatttgaatatagtgtccatagtattttaaatacatagaagtgaacatatttcaaatgctttgcagctgtgtgaacgtctgccaagccccaatggagaatcaactgttagctgtgatttgattgcaagcatgccaaatatttcatttacaatagccaataaaactttcagcctaactccagaagaggtaaggagataatatattaggcttaatcacttcaaatatcattaatcattactgtatgatctggtcatcatgttgaaattactcttcttactttttatattgagaactgtaaattgtactgagaggtggcaaaagagaaaaaaaacgcccaaatataatttatgccacaagcacatgtggcaattgttaatacttgatactaaagggtttcatgtgtaaattatgccttataaatccacctgtcttgcattttctcatgttgtttagttgatgtataattgtcatttttctctctcttctgcaaatgattctgttcttcttaacaggctatttatggaaatgttgttacatgcttataaaagtcaaggtcatatttgctttggaaactaaaagatatcaatataattttgttaattctgaccatcatgttctaaagattctgttcaagagtgtgattttttttcttttcatagcaaagtgaggtgatggtttttaccagatcaaatggtgctccgcataactcttgcctagaaattgtttgcaaggtcatatctagggctccaaacaaaagaaagatgttcatgagcatctcaggcttggcttgatgagaggcttgattgagctcatttcattaggaaatgagccaagtgcaaatgccatttaaagcttcacagataaatgagcaagcctgaacactccgggtttatagaaagaatatagaatcttgggcttgatgttaaactctttcaagctcattcttttaacaagccaggcttgagcatctactgtcaggccccactctagccctgcttgggctcagacgccctttttacatcacaatgaagaccgggaagcttattacttgggtcacagctggctcttttgtgcagctaaaattggaccaaattttgttgttaactaacctctcaagttgatattactgatgattagctatatgaacaatatatagtaaaggaagataggaatggtatgatgtgtctcaactccaacagatattgttaaatagatactttagcagtttgggtttctctcttcagtttgcagtgattttaccagggttgcttggtgtcattattgaactgaacaatacaatagaactcattgaaggagaaccatttaagtttaaacctttgtaaactctttttgtgtttattatgagaaataactctcagaagtattgctatagtccttgcactcacaaaaagtgtccttcctctctctatcaattgacttgctacctacttattttcttacagtctacctgcaaaatccaaatagatggattaaggcttataatgtattgctttcttcttctctcagtacacacaaacacataatagtgagctcttctgatattagtcctgcgtgtgaatattattgataaaaatgcttaaacttttgatcttcaattcatcataactgttcattttcttattccaattttcagtatgtcctaaaagttgatcaaggatatgcaagtgtctgcataagtgggtttatgggatttgacatgccggctcctcgaggtcccctctggtatgctgtgcaattttatttaccacattagaggatgtccccgacaagagaatataccatgtaaacacatgaattgcatgtgtggggtattctgagccttttctaacgaaaatgcttttgcatgcaggattcttggagatgttttcatgggtgcatatcatacggtgtttgactttggtaataaaagaatgggatttgctaaggcagtttaagaaggcttttcatgccttgctttgaatatatgaatttgctttagcagatttcactgcaagtgtgtaactaatggaatcaaaagcatataccatatggatgtatgtagtttcatgaacatagatcacttactagtttgtaaaatcatggtaactggtgcttttgtgtactgatgattgtacctaatacatatgttttagggtggttgtaaggtcagtgctgtatgtattggattcacggtatcatactacaaccatcctgttttcagaaacatttgaacagttgcaagttaagtgggtcaatatatcaagacacgacattatccaattgctcgcatgacaggtctagcatctaaattcattttttcctcacgaatcttgattctagtatcataaaacctgcatatggcttcctatttgaaactaattttggttgttttttgtttctacaagtggcactaagggaattcgggtcggaaatgcccatcccatttggttataaactttgagatatttctagctcgtccgcattgcaggattaatacttttctcccttggtccaagtatattattgtgcaagcttctagggtgcggacaagctgagccaagttgctcaggctccatttatatgtgtgaaaggggtgtccgagctcgagatctgctgaagttgagctaagcttagcaacaaatattcaaactttgcttgcttgttaactgaatagcttcttatgaagctcggacccagcttctatttatttttgcattcatgaaatgtgaactcggcttatttcctaagcccaacagaggctgtttagattgagccattcaagggcagcttggttcatttgcagctttattaagggcatctactggattaggacaataattgtttaatattggaagataataagactgaaattagaaacagcgctatgctctggacttaaatttccagttgttcagttgagatcggattcagaactcaaaacaaaagcttgtttaaagtgaggatttggggagagaaaggaatggtgttaagattgagaacaacataagatgaaatcaaggatatgcttttattcgaggattgagattgagactgaaatcaacatattaaataagaaaagggagcaattagacacgactacgtgggagcgaccggaagtgggatagaaactgacatcaaggctgttactgaaatcaagccaacgtgaaatttgagcaatactaagataagtataataatgtgaatggaattggcgtccaagatcagtataaaaactaggatatggatcatgtcagaaggattttgatcgatgccatgagtaatggcgtcgttgttcgcttaaaataaggttccagtatcatgatggagcatatcagaaagcatcaccactggagcgtatcagaatgagaggagcaaatcctattgttgacagtgttaattgatggctcttcctatgagtatgctttattgacgaaaaaggtttctaatctataatatttcagatagataattctgtttcttttcctaactccagaaccatctgatctcctgctgacatcccaaatgagccactggagaattataaacctaatattctctgcgggaacactaccagcatagcagaaaaagtttcagccagaggatcgttacagccatatgaggcattcatctaacaccagccaaacacatcttccataaaacacaattactgcaacgaaagcaatttctaaaaacttcagttgagcatggctcgacttttagtgtgacccgatttgtcattcaatctgacttttttgaggagacgacctgagcaaattttttcatgagacacacatacacacacacacaattaaaaaaagaagaagaagaagcaatgtttagtaacattgcattattattaggagttgaaagtaacaaaacatttttcaaattttcaaactaaaataaaggatttggattgctacatatagcatttattcaaaacaatccacaattcttataaaataagaaaataatattaaaaaaaaacacaaaaacaacccacaaagagagccgtgacatcactgattactgcatctgagacctggaaatggagggcagaacataagaaaatattgaacagataaatggttcatcatgacataccaagtctcctatgctcctacaaaaccacgctactgctgttatatagacatagcatagtcggaaaaatgctaccacaaggaaacacaatatatcacccaccactagacaaaattcaaaggacataatatgtttgtttatgaggatcacttaagctgcaaaattctctcaaacgaggaacgtttctagtctgattgcaaaattcttgtataggatgctctctctcctacatgaagtcgtgctttcaaggaaaggagaactatggtaaatagacaacttagatttaaaaagagatcagtgtcagacaccattgtgtgtgctaaaattaagaatcaacatcaatcacacatttctctccttcataagataagcacataaacaaggtgtcacaccagcaaactagaaatagaaaacaattatagcaaaccatgaaatatattgataataaagtaccaatattgtgcattacaaagaggtaacaggatgagcagtaacatgaaggatggtatgtaccatacaagatacacttcccagctaacccagctagcagaatcccctagtaaagtgctcatagaaagagaactgacaaccgcactgctttgatcaaatgaacttctttgatcattctctttgcaaaatcacaccgaagatgctgagaatggtaaggaaacagtttgggtcatctataagctgtcagacatgacaagaacgaagtaagtgtcctttgttatttttaaatcactgtacgtggaagatatgtaatgccatatagcttgtgctcaaacaagtaatggttttagcatactatggatgtgttttaggagcatgtctcctctaaatgaagtattaaacacaaactatcgtgcatcgcagtcatgctggttgccagccagcatggcatggctagtcatgttccagggcccaacttatatgacagggttgtgtgctggcctccaccaaacatcatcgacccttatgaaccagccacaggtcctcattccatgacattatccaatggcagcatacatactttaggcatcgatatgaactatgaagacaccagcatctaaagtcttcttttgaaccggtctcatataattattttggcacttcaggattagaatatcaaccttcagattcaattcctgcagaattgtaaattgctcacccaacaagtcatcttatgtagcatattgatggtttttttttttggatggaaatgtaacattcgtgttatttggagaatttgtccaaattcctggtatatccttggtggacaattgctagattcatacagacatgattgggcctccttctaaagtacaggtatgaatgtcgctgttcatttcatactccttatgacttcaaatgcattattctttaaactcctaatcacttctattcaatcttttcaaattacatcctttaatgctttactgttgtttgagagaaaacttattgctttactgttagaaaaaggattttctcctcatacggattccagccatccaaaagggattagtcctacagtctagactggtgcaactcagttattgcacacatcaaacctgccactcgatagatcccaaaagaacaagagaaacagagataagaaccaggaacaaaagccaaatgattcagcctaaggggctcaagacgaaattattattctagaagcgagcattctatattgaatttatcaagctgattcttccctaactggattatacagtgcttaaaaactttccagacgagcaagaattaggcacgcacgcgcgcgcgcgcacacacacacatatacatacatacatacatacatacatatatatatatatatatatattagtttcatataagcaacgaaacacctcatagttttatccagaacttatcaatggaaagcatatttcatcagcaacactaatgcttgcttcatcaaaaatttagtaatgttcaacaagtaaatcccccctcaattccttgtacaatttcaaatagcatcagtaagaaaccaagtgttcaaacataatgcttctgaagtgtttctttttttataatggaaacaaacaaaaactatgcatttccaaattggttttatttcacatgtaactacagagaagaggcaatagattacagaaaaccaaatgtataccacactttgattacatccagcatgtgctacagctaaattgtttacctccctgagcccatgttattgcaagaagtagccagagaggaagagcacgaaagcaagcaaaaggctgccatagatgaggaatgctttctgccctgctgtaagtgtgttgccccccaaaccaaactgctggttctgcgcaaacccagcaatctctacactcttgctctcgaagaaggacttggcggcgccgcacgtcgggcaccgccagtcgtcggggagcttcgcgaactgcagcccgggcggaattgggtaggacgggtccccgaccgcttcgtcgtagcggaaaccgcacgaccggcactcgtaaattccggtgttgagcaccgcgaaccgctcctcgaagcgacgggggtcgagctttggctgctgttcctcgggggccgggggtgggtcaggggaggggtcttcttcgggtcgggcgaggggcttgtcttctttggagacgtcgacggaggagatggcgaagcgatggagaattactagtggcctgtgggaaagggaaagggtgggagttttggaggttgggaagggatgggggaggtgggatttagtgggcttggtggcgtggaggtggtggaaggagaaggtggctctagctgtggctgaagccattgcaactctctctctctctttcgctccctctctctctctattcttttttaatctagagtttggtgtggggtctgatcatggagggaagcgtggaatccattgggaggatatgccaagtgtttggaacagaacaggggtggataaggtaggggagaagtgccggtggacgtgtgggtatttgggcggggttatgtcaccacgaggtgaaccgatcaccagggttggccgttgattcgagagcgtagcacagcatcggctacgaagatttgcgtaggaaataggagacttcgaggttacgtactcgacacgtgtcgaagatcttttgcggagtggcgcggatgctggtcctcgagccccgcggttttgggcttaaagagtccgggttaggtctttcacgcgaaagaccagccgctttgtcacggatttcgtctcttggacgagcaaatccgtgcggcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctgatttgaccttgctcatccaccatcagagccgcaagctcagccttacgacttaaagcatcagccacttgattcatgcgccctggcctatattccaggaccatgtcaaactctgccagaaaatcttgccaacgggcttatttgggagatagcttcttctgtgtttggaagtagctaagggccacattgtctgtccgaacaacaaatcgtgacccaaggagataatgcctccatactctcagacagtggaccaccgctgtcatctccttctcgtggacagtgtatcgtctctctatgtcatttaacttccgactttcaaaagccaccggatggccctcctgaattaggacccctccaatagcataatcggaagcatcagtgtggacttcgaatggcagtgtatgatctggcaaccgcagcactggctcctccatcactaccgctttcaagtcctcaaaggcttgctgacaccttgaggaccaatcccacgattggtccttctgcaataactccgtcaagggtgcagcacgatgggaataacccgtaataaaccgtgtgatctcacgtaggttatcagattttttttgacattttcaaatatcattgtttgccatttttggtaaaaatgttgaatgagtttaaaaaaaaggggaactttcttgcttatctcaggtcccaatgaaggatgagcctggggaagttttcttgcatggaactttgttgcctgggatcaatgatggaggaatatcaaaaagattaaatgatcggttacatttcaggactacagaggaaaatatctagaagatattaaattaacatcataggaaaaatcagcatcattaaaagaataaaagtaaaatgttctgctatcttctataatcagatgtgcaagtaataagttgtaaaattttaaagattaaaatatatgttgtgggggtcatacttcctcagctgatatttttgagattcaggagttcttggattaataaaaatactaatgtaaagctcgataataaagccgatcttagtgaaagattaaggtcatcataaagtcgatcttattggaaggttgagatcatcataaaatcgacctcagtggaaggctgaggtcatcataaagccaattttattgggaggatgagatcatcattaagccaatctcatcgaaactctgagatcatcataaagctgacctcatcggaactctaagatcatcataaagccgatcttatcagagctgagatcatcataaagtcgatctcatcggaactctaagatcatcataaagccgacctcatcgaaaagttgagatcatcataaagtcgatctcatcgaaactctaagatcatcataagaccgacctcatcagaaagttgaaggccgacttcatcatgaggtagaaggtcgatctcttagaaagccatctctagcatatagcgatatcagtgagaatcatccgagtattgtattgatcaaagtctacttctggatcagatcgattgaatactgatcgggttcaatttagctcaactaaacatcgatctgagctaacctgaattaacacctgatgaagcattataatcaatttggctatctatcaatttgaatcgatgtgatcctaaaatatagatgattattatacaattatcttccagcttgctacaactatgttacaacttatcaccagctggcacatacaactaagtatgaattcatcaccggctggcacatatagctaagtatgaactcttccccaactggcacatacagtcaagtatgaactcacttccagctaataaatatagctatactctagctcacttacagccagctataacggcctaacaaattctgtaatgacctcatcagcccctttataaatagaggatcagggggatcctccaatggtaagttctgatctgccgaaactagagtgggactgtcaatgaaaactttgccagtttttgaacaaggactttagtttctacaaagttcaatctctttagttccacacaaactctcatactctattctatttttttcatctcctgttctcgaggtttaaattgacttaagcaccggagggtcaagaatcataggatctccatcgatttttgacttattttgtagattttcttaaagctatctcagattggactgctaccgatctctagctcgacttcgtccgatctccctcgtctcagattttgagccttgtagcaacagattgacatcaaaggaaggagcatttgtccaaaaattttataaagaaatgatgaatcagagagcacaaaataactctatgccttcaccgtcttctcctgaagacgtgtcgaagtagttacacctccaaattagctagatggtccaaccatccatgaactggttgacgtcaactatcatcatttgaaccatcccagttaagctcaaattagggggcttcgaataagggagaaatctcaatcaagaagaaagatctagatgaagaaggagatcacaacatccaaaaaggatgatccaaacaaggaaggatgttgcaggatccagataagaaattatgaaaatctcttagtcatattgaactcttattttctcatctgtacttttaaattcttgataggatcaaaaattaggagggagatttctctttgcacactcatcagtaacgcctccaatatgcttggacaagatctagttggagagcctcatgaataggagcaagctcaacacccagcaaaagctttttggtcacatcgtcttgtggatggggccgaggtccgtaagcggtcccttgttctctcgcacataccccacttcggatggtatcgagattgtccgcacgaggccctgtgcatggccatccatgcattgactctcaagccccccaaaccaaaacccacggtggataatgcgccatgttactccttatgcttcattaatttccaattgcgcactgctcattgcgcacgtgctttgaaagttaagatggctcccctcttttctcactcgtcccatcccatcacaagtgacaaaaaaaaaggctccaacccccatcagaaggttgagcttattaaaaagccgacttcatcagcaatctgacctcatcaagagaccgatttcataaaaagccgacctcatcagaaagggatcgatcccatcaggccgacctcatcaaaaagtcaatattcggatcgagcttaaactccaaagggcaaaaatgatgaaaattcgatctccagattggtaagccctgaaaggtcaagatggaggtaagatcttataatcaatgaaaattcgatctccagattgataagccccgaaggaccaagatggagataagattttttgatcgatgaaaattcaatcttcagatcggtaagccccaaaggatcaagttagagataagatcttttgattgatgaaaaatcgatcttcgaatcaagtttaagcctcgaaagggccaaagcaaaaaatactgatatttggattgagataagtcctgaaaggatcaaaatatgatctctggatcaatataagtttccctaaggacctaaataccgaccttcggatcagtctcgagaagacccaaaacccgatctccggattggtaagcccagaagggctaagatgaagataagatctcttgatcgatgaaaattcgatctctggatcgataagtcttgaagggccaagatggagataaaatctcataattgatgaaaagtcaatctctgaattgagcttaagccctgaagggtcaaagcaaaaaagtcgatcttcaaatcgagctgaagctccgaaagggccaaagcaaaaaatatcgatttttggatcgagatgagttccagaggctggctagttttcagtctggctttgctgctccatcttcgattctatatctgatccaatagtgagctttgctcccattgattctctaggtcctcctttaccgcttgaccctgtgaagctcatttggttgaataagggactggtcgaaatgaccaaaattcaatcttcagaccgatataagtccccctaaggacctaaacatcgaccttcggatcaatcctgagaagaccaaaaatccgatctctggattaaatctcataaaatttcaaaatcatgattggaccatgagtattcaaagtgaaacatttggtctctggagtggacttcactaaaattttatgcagaaaaattgatctccggattggacttcgcaagtctcgaaaagataaattctagcttaaaatttcatgtgaaatgccctcgaaagagaaggagataaaaaatctcaagatgaaacttttgatgcatgagagacttgatctacccataatgatatcggacaggatccaagcagttgacttgaagaagcaaatggtacagatttgccacatcggacaagttgaaaacttttttcttggactacttcttttgtccaaaacaacttctttggactcaaacgcgcaggtaagtattatgggaatcataccatctcagctgatgtcctcgaaactcaggagttctcagattgataagaatactgatataaagctcgacagtaaagccgacctcagcagaaggttgaggtcatcataaagccgaccttatcggaaagctgatgtcatcataaagccgatctcatcaagaggctgaggtcatcataaagtcgatctcatcgggaggctgagatcatcataaagctgacttcattgagagctgagattatcataaagtcgatctcatcaaaactttgagatcatcataaagccgatatcatcgaaaagttgagattatcataaagtcgatcttatcaaaactctgagatcatcataaggccgatctcatcagaaagctaaaggctgacttcatcataaggcagaaagccgatttcttagaagccatctctagcacgtggcgatatcagaaagaatcattcgagaattatattgatcaaagtctacttctgggtcagattggttgaataccgatctgattcaattcagctcaactaaacaccgatctgaactaatctgaattgactcctgatgaattattatgatcagttcggctatttatcgacctaaatcgatgtgatcccaaaatacagatggttattatacagcagtcttccagcttgctatagctatgttacaactcatcatcgactagcacatacagctaaatatgaattcatcaccagttggtacatacagctaagtatgaacttatttccagtcggtatatacaaccaagtatgaactcacttccagctaatacgtatagctatactctagctcacttacagttggctataatagcctaacaaactctgtaacgacctcaccagctcctctataaatagagggccaaagatcctccaatgataagttctgatctctcgaaatgtgagtgagattattagtgaaaattttgtcagttcttgaacaaagactctagttcctacaaaattcaatatctctagttccacacaaacaaccctactctattctatttttttcacctcatgtttttgaggctcaaactgatttaagcatcggagggtcaagaattggaggatcttcacttatttttgactcattttgtagatttccttgaagccatcgcagatcgaactgctatcaacctctagcttgacttcatccgatctcccttgtctcaaattttgagccctgcaacaacaatatgaatgtggaaaagataggaaataatacattttcttgaaagaaatccaagattgatacataaatgtagaaaatattagggactaatatataaaaacctaaataatcataattttcttattcgtctagtagataatcttgtttgttcaatttgttcatataaatgtaatatgacataaaaaagatttatagcaagtagatttttaatttataattcactaaattgtggatcttagttggatttatgatcttttttttatacaattagatggtcacatcaatctagtgcgagaacagttcaaaagatcaagatacacaaaatcgcacaagaccgacgggtaatccttaccctatctccaaatccagatactagagtgctctgcaacaaaggctgccacccagtctgatatagcattagcctcttgataggtatgctaaactctaactgcaacagtttgacgaagagaggtccagacatcccagatgagaggatgggcttcgagctgcctagcacctctctgaatccaaacaatgactgtggcaaagtcactctcaagatagatcctctctgcatgaagctactgactgacaaaaatgacacctacccagacagtatgaagctctgcaattgggacagaaggctcaaaggggtgggagccaccagccactataagtctcccatcagggccatggataacaaagcctgctccacctctcctgtccctgacacagccatcaaagtttaccttgacaaaccccaaggatgggggctcccaagagatggatagaaccttacaggttgttgtcagggcagccagggagctccaggacctggggatatcgagggacggagtggaagcatcaaactggtagtactcctgaaccagatagacagctctatcaaaaactcgatgaataagaatcatctcaccgtcgaagacaagactgttcctcgatagccaaatttgatgagtaatataagccatccacccaccaacagcagtcgatccgttagccacactctgatgaatccagtcaaggaaggaaaccagccatagatcattgcttgcctcccacgggtaaccattcgcctgtctccaaatgaccctcgtcttaggacagtgcagaatagcgtgctccgtacactgtggccgactcagtatgcgaagcgaagtatattgcggcatgtaatgctgcaaaaaaaactatgtagctaagaaagtttatcatcgagcttggagtggcaccctccatcgatgatccagttctgctttattgcaacagtactggagccatagctcatgcaaagaagtcgaaggcacatcaacgaacgaagcatattctacgtcgctataccttatccgagagatcatgaatcgagatgacgtcgacctttagaagatcgacaaaaaaaaaatttggctgacccattcactaaaatctttatagtagaagagttcgaagatcataaaataaagatggatatacgttactataccgattagctttagtacaggtgggagttattgagaaatatatctcaaagtcaatcgtcagtctgttgacgattatactatttgatgtaattgtatatgaattaattattaataaaatatttattgaataaattttatcataagcttgtacatcttctatatcgaacttttgtgttatgatgaaagtccttaagactattttaaatcgataaagaaagatttatcgtttagtccttaaatgagttcgtgaccaaatgatatattattactaggatgatagacatatcaagtgtaggttatttgtgccatataagttgattatcctcttaactaaggagtatggagatgctggtatggcatgcaggtgaaatatagaagtacattttattgaatgtgagcaactctggagcactctgctgtcaagagttattccaaaaagatatggatataagtgtccctctgatctgagatcatcacggtgacttacaagtaactcactgtgctttgatgccagactatctgaatttttaattcagaatcgaaagatttctgggcacagtccagtacttgtgaagttggtacgtgagtcaagatagaattgaccactccaagggattggagagaatactttgtgtttcaatttagtaagaccttgatcaggacagtccttgtgagaagtcacaagatttattaggttgagacacataatggatgtactgttaagagttaacagtttaaactctaagttatcctagcatcaagggtcaaagagatgaattatacggtaactatatccaagtaagttcttgagcattgctttacatacattcgatctatccgaacgtcgggtaccattgctagatagttactccgattgatacagaaatctgtttctgtgctaccgacttaggttcgaatctatggggtcacacacattagaagttcttctccgatcggatggctactttggtgaagagtcccactagacggagactttggtgaagagtcccactggattgggactctatcattaaagaattagttagtgattaaattactaattagctcaatttaattgagcattaaagtctggatcaagtttgattgaattggattcaatcaggtcaggtctgattaggttacggtaaaggagaattgatcttgatttgatcgggtctatgactacattaattcactgatttaatcaggtttaattgaggttatgggagcctaaatagattaagtttatcatgttttatttggatctaattggattgggtttgaaagaaattcaattgattaaatcctagaatctcagatgaattggactctctcccttgtgctacccagaaagacacaccttttctcatcatacaaaacaagtttgtacatgagaaaatcagaagctaacattctttttgtcagccactttggataggtattagttgtttgggttggagttcaagtgaaactttgaatttgaatcaaacttcttatcctactctacctacccaccggctcttgtgaaggtgcctattttgtgtgacaaaagaaatagcttcaggttatttttcatgcccaaaaccctctggttggcctctttttaggtcagataagggtgagaaaaagttgagatttaattgaaattcaaaatagtttgaattgcaacaaactctgggtcttatcctatctaatttgataatgccggcaatcagaaaaagcttatgcttttgtgcgccatcaagtctctaatttttaccatgagataccagagaaaaaaaaaggtcgaatatccttcttggggcatgaggtttggggtgggtttctacctttttggcgtgtgcaaagaaggagatctatctcttctcgggtgagagacctagaatcattttagggttttagggtgaggaaaaaactaaagagaagagagtcttcatctaattttcctctaccttccagcaaccttctctaatctatcttcgacatcgaaaaaattcgagacgatcgaaaaaggacatcaaactaaatccgccatcagaagccgactgcgcgagctagcacttctgcagagggctgatcgatccgaggacttcgtatgaaccatccgtagagattggatgcttgtgcggctgtgagtaaccaacgaggactttcagatccatattctcgatcgtaaagttcgactacctatgctcagatattgggttcgaaattttcattgtggtagattagatttatcacagtgtgctaatttttattcacatgcttattattttaaatttatatttttatgcatgtaaattcatgtcatatccgtttgtaggaattttaagatcaatcttatgtatgctgttgggggatacccaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcggcttacaacgccatacttggacgacccggattgaacgccctcaaggcgatcatctcgacgtaccatctccttgttcggttcccgaccaaaaatggaatcggagagatgcgcggagatcaacagctcgcccgacgatgcttccaaatcttcgctcaaagcgacgagtcgagggattctctgacgatcgacaagctggaccaacgggaggaggaagaacgaggctcgctggccgagtagctcgaggcgatcccgataggagaaaatcccgacaggaaagtttgggtcgggtctcaattgcccgacgccgaacgacgccgtctgacggagctgttgacggccaatgccgacatatttgcttgatcgacagcagatatgtcgggcatccccgcagaaataataacccaccgactcaacatcgacccgacgatgagaccggtgaagcagaagaagaggtccttcgctccagaaaggcagagggccatcgacgaagaagtggacaagctactcgaagcaggcttcatccgagaatccacgtatcccgattggctcgccaatgttgtcatggtcaaaaaagccaatgggaagtggaggatctgcatcgactacaccgacctcaaccgagcctgcccaaaagatagcttcccgctttccaagatcgaccagctggtggatgcgacgttcggatttcgactgctcagcttcatggacgccttcgtcgggtacaatcagatctggatggtgcctgaagacgaggagcacaccgcgttcgtgactcccaagggcctctactgttatcgggtgatgcccttcagactgaagaacgccggtgccacctaccagcgacttgtcaataaggtcttcaaagaccagatcgggcgcaacatggaggtatacgtggacgacatgctggtgaaaagtatgcagatctcggatcatgtttaggatctcgaggagaccttccgcacccttcgacgacaccgaatgaagctcaacccgaccaagtgtgcttttggggtgacctcagggaagttcctcggattcctcatctctcagagagggattgaggccaatcctgagaaaataaaggcaatcctcgacatgcgtcatccgaacaccaagaaggaggtccaacagctgaacgaaagaattgtcgctcttagtcgattcatctctcgatcagctgaaaggtgcctaccgttcttcaaaactctgcgccacgcgaatggtttttcttggtcggatgaatgccaacaggccttcgaagacctaaaaaagtacttggcttccccgccgctactcgtaaagccgcaggtcggggaaaccttgtatctctacttggccacatctcctgaggcgatcagttcggtactcgtccgagaaaatgagtgccgaacccatcagcctatctactacaccagcaaggtgctccacggggccgaagcaaggtactcagagacggaaaagatgattttcgccctgaccgtctccgcgcaacgactccgtccatacttccaggcccacgccatagtggtgctcaccaaccaacccctgagggcgatactgcgccgacccgacacatctggatgactcgcgaagtgggcgatgaagcttagcgagttcgacattcagtaccgaccaaggcctgccctgaaagctcagatcttggccgacttcatcgccgaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttttaaaatatatatataaaatttttatacatctcatcatccatgatcttcaaaaattattgaatgagctctgtcacctcctccgatgacatatccagcgaaactcacatcgttcgcccttgcagtgcctctttccagctcgtcttcgattggataccattttttgagatacccggtcgttctctcatcttcttcgcgatcgtccatcacatcgacgattgcgatagctaatcaggtcaccggcgaccacatctaagaaaaaaatagcccgaatctcaacgcactacgctcaggttgctcaggtacagaaagagccgctctcatttatggcctttttgaccacaagccacaacaaaccttttttttttttgagagtactacaacatacactcgatacggctggtgctattcatgtgcgcatgttgttggaacccactatctattttttttgggtaaaaagcccattatttttttttttgccactcactgaccacttttcgcgtattatttttagataacaatgattactaggatagtaaaatataattactggagttgttattattttatttttatacaaaattatattaagagtctcctttaaaacaaatgcttattatattggctcggaggaataattactggagttggtattattttacttttatacaaaattatattaagagtcctgactcaactcctctaaaactaatgcttattatattggcttggtggaataaataatttggatatatccgggtcattgaaatttccctcttcgttcagggatttatccggaaacggcttcggaccctgccatccttcttctctctctgtctgactcacaatcacgtggcaccatgtcaccgctacctgtacgtgtcatcgaaattgacaccaccaacatcttagccgtccgatcgacaaattccaatcacatctctggttgaccaatcgaacggcccacaggaattgttcctttggttcgaaaccatcaatccacacacccttcaccacggaggcccaacgagtctaccatacaaaaacacgaaattggagccactgagatgagatcgaacgggtctggttaacgattctacaccgactataccgtgtatagccatagaggtgggtaatagtaggagtctttctgaccccgtgccaccgcgttcaaaccctaaccctagttttaacccagatctctggatccagacccaaagcatcgttggccaagtgcttgagaaaaagccgagaagaagtcatgccttcagctgaagacgaagaggagcgcgccttcttcgacgacgacgacgacgacgacgacatggagggcgacgacagcgaggaggaggaagaggaagactacgaggacgacgatgctgaggccgtgcagccacctgccttcgccggcgtggcagtggcggccgcgcctcctctcctcgcgaagcccgcggaggagggactcaatggcaccaccccctccacatcctcctctgaccgcgccgccccaaacgctaaccccccctcaaaccctaaccccaaccctgctaccgccgcagatcccggcttcgccccgcagaacggcgccatccctattcttcccctctctgccgctgcgccctctactcccgccgcgacggcggctggtggcctctgcacgccatcctcctccgatcccgtcacccagccgtacgaggacaggaagccgttccccgtcgcggtcgccgctgtcggcggcggatacgatgactcccggcggctcttccagcggctgtggaccgacgaggaggagatcactatcttgcaagggtttctcgagttcacttcccggcgcggcaccaccttcgcttcccaccagtacgacaccggcccgttctacgaggagatcaagaagcggctccagctggagttcaccaagaaccagctcatcgagaagctccgccggctgaagaagaagtaccggaacgtcgtcagccggatgcggtccatggggaaagatttcgcctttaggagctcccatgaaaaggacatctacgacatagctcgcaatatctggagtgccaatgtgaagagggctcgtgacagcgacgacgacgatctcaacaccccgaacaatgcctatgccattgaagccgtctccgctcccgatggagccatgaattcagacagacggatgtcaagatcacggaggcgtttcagaaggagaacagcagaagcggcaacggcaacggcagcatcagcaagccccgcaacagtaggggttccggtagggaactcggtcccggtaacccaagtgccttcgtcgtcagctgctgctgcgatcccgggcatcatcgaggagacggtgaagagttgcctctcaccgctgttcaaggagctgatatactcggcaaccggggggccgctgggtccaggtctcagtggtggggctggtttattggggctagggccaggaccagggccagggctaggcggtggtgcagcggcactgagcccaataccattctgcctcggcggaagcccggcaagtcttccaggctcaggggcggcggtggatgagaaatggaagaagcaacagatcctggagctggaggtgtacttgaagcggatagagctcctgcaagaccagatcaagtctacgttggaggagctcaagtcctccgggagctgataagaggtttcctttcagaacttgtacttcttaagttgtggatctgatgttttcattcgtaattattagtttggataattctgtcttgttaattagaaggtacagggactctggaaataactatcctttcttctcttttagttagtagtaatctccattcagtttagttacttttgacctgttactctacaggaaagattacctggaggaataggttgaaagaatttgcctgcattgttctctactacatcatcacttatgccttgtaataaatttgccatgtgaatacctgtagtcttagtcttagatgcttattgtggatcgttatgttagagggatgtgtcttggtcggggaaatttctttttcaggtggtataatattatattattttatgacaaatgaaaggagttattcatgttcaccatggtccagcgaattttgagcaagtccataatatgctttgacggagaagagtcgtctaaattagatgtgaaggtgggtgaactagtgttaggtaattgttcttaatgcaatggttcacctctagcctataactgtagtgtctgaaatggctgtgggaggtatccttggagggtacaaagttcctcccttctacatcaagaattaatccagaatgcaacgtggaaggaagcttctggttgttataaatctatcatgacatctaaggataaatacatagtatggacatgggtgcttttggcctgttgatttttgtaaatggaaaggtaaatgctttgaagcatgcaatttctgaagatcaagagtataaaacatagccttgaagcaattcagcatttgatgtcaagtggtcctcaccctaagttttcttaaataatttttgatgatgaaagtgcctttttttttaatacttcctagatagtaatatgctttgcacatgaacatgtgtacctttagtattcatttacactagttatttataatttacttctcactacactgattttcacattatgttaatacatacgtgtgtgtgtgtgtgtgtgtgtaatttaattttatatcttttcaataaatttttatgagttgaagttgaaacatattttgttccatggatttttgcttctctatttattttttattttttttgcttgaatatgggctaactaaatgaaacaacctgaaatagttcctagtaattgttagggttctttggaaaaagaatatcattgaacaggaattctaataactcattgggtgggatggtggaatgagccgagaaataattgatattcagagaggtcatggattgacctatgagtgaaagagtaaagggtcactatgtgcccttgaaagttgaaacctttatttattggattacaatattttggtatgagttggcggaagtaaactaaggattccttgtattctgaaaaaagaagcatcatttaaatttcttattcttgtttagcttctaaatcatgtttttaattatctggttggtgcctttatatttaacaatgagcacttgagaaactgtgtagaaaagagattttcatttatttttcatttttcaagtcaattatatagcacgagttcatgttccggaatgtttgttatctaagaggaattctggacaaaaggaattatttgtctagagttgtcccagtgggcttgttacagcaattctttttgaagatgctggatgcaatttgtgatttcaagtccaagaacttttaagagaatgtttgcatgtcttctagacgcaagagatgtattggggtttttaagagaattttttttttttaaggagacagaagatgctagagtctatcttctattctttgtaatgccaaacacttgggacttggctccactgccgattggactccacttttatttcatctctcccaccggccacgcaagccgctagcaacccaccagagagtggatttgtcggattttggctcaaacctatgcagtataatttatctactcaatttttttttttttggactgtaaatacaatgttcacatatacggtgagaattgtcatatgcttatgctatttggcatttgaatattctactttatggatatctgcatatttaatagtaattggacttctatcagcttatcatgcacttggatacttcttatactgtattttgattcatgatctaattctttagcatctttattgatttctgaaattgtttaaaatatttttattaattcaaactttcggtccaagaataccaggaccatccgtttaatatctccagactatccaaaatactctaaaattttgtgatagcttgcttctattttgtgctatcattttttttgttgtgttttttcttcttattattttcaaaattttaattaaacggtggtggatgggaaagttgtaagttgtaatgacagtattagcaagaggcatatgtgcgtttatgataatgattgtgctttttttatgaaatatggaggtgccgtgtctggttttaggaaatattatcattcttctataactcaggtggtaatctgtggattggattgaagagtgtgttcgccatgttgaatgggcattctcatattggaaagtatcaagtaggttgatgtttgaatgtataactttaggatattaattatcttaaaaattattaaaagatattaagatcttggtctcaggaagttggcagtttcgcgttttaaaaagctgagacaatgaggcgtctatggtaagtcaatcactgacaaatggataggcaagtaattcatttgatctggtagttgttcattcgattgatccgagctaaatgccatctcggtgcccaaatttgtttctgattataaattctagcatatcgtagaacatgttctttggaaatgttttatggaaattatggccctgtgacgggtccaacgagagttaagaagctactagaagggtggagctgcacaaaggtgcgtatcctagtgagggttagcttcggaatactttagctaaaagtgacacacgtgcacgaattaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggacaaggcccctggacttaacgatttccctccactcttcttttgaaggtattggcctattattcatggtgaggttgtggctatggtgcagaagttctttgcaactggtcaaatatcggagctctagaaccagacctttattgctttgttaccgaagtgacaggatgtaaccgaatcgggccacttcagcccgatcagtctatgcacaactatgtacaaggtcggtaactgatggtatgcagattgaagcctgtcctttcatgattgatctctccaatataggatacttttgtgggtggttacggtatttcttacaattttcttatagtacagaaattcatacatgatctcagtcgtgccacacttcaccgcagtcttatggcgatcaagctcgatacggagcgagcttgtgatcgtatcagttggcgcttcatgaaggaggctctttcggattttgacttccatccctattggatagattggactatggcatacgtttggagtccatcattttgtatcttgattaatgggatgccatcagagtttttctactccactattggcctgcgtcaaggttgcctcttatctctctatctttttattatatgtgctgatgtcctttcgcgagctcttcgtgctgtctctcttgggacgagcttggacccctatgttcctgtcctaggggtttagccaatattgcatcttctatttgcaaatgattgcttgctgttgggatgggccacgttctggaatgctattggctttaggaggattttggaggactactatggtgcctcggatcagaatgtgaatcttttcaagttagcgatactctttagtctgaagatatcggtgcaattgcagcacttgattcgagatcggttaggtgtggccgagcataacggggttcttcagtatttggggattcctatctttggtcgtaggttgaggatggcggactgtgttggaatggagcagaaagttcgagagcgtctggaaggatggtagtcccgggctctctcgatgatgggtaggattatcttgatgaggtccattctcacttctatgcctgtttatttactttcgaacattattttcaccaaaaattttatgagcaagcttgagctgcagttctggcacttcttgtggcgttccaaatctaaagggatggtggtgtacatctgctagcatgagatatggtctgccaactagtatagaaggatggtctaggcatttagtccttgattacaaggcgggaggcattgattgctcgacatactgccaagcttctacttgaccctgagtcgatgtagagcatgatgatgcggcgaggtacggcatttggtcgaccagtggcaagctacaaatcaatcatcgtgcttcagttatatggtaggagatctgtgtgcatgcccctaatgtgttccttcagactagatggttagtgggtgatggtcattctgtcagtattttgcttgatgcatggatagccgacatcccattggttcgttggccgacatatattagtacccaggtgatcgaaactatgagggtttgtgatcttctccacactaacggttagggttggaagactgatgtggtgattagtctttttcgagaacttataggccgatgagtactgaggattcctacaccttttcatcatggctcggatgttagggtctggcaatcatcctacatctcgaggcctgtgatggttgacctctatcgactatatcatcaggagttgaccaggcatctggatggtggatggatttggaggctcggagtgcacccgagagttaatcttttcttgtggaaggtagcttggagatatctttcgatcaggtcttatttgcgtgagagagatttggataccagctagagtgttcctgctgtgctagggaggaggagacgttggcacactctctcttttggtgcccactgaccagacatatctggaggatggttggtttacatcatcgcgctgttcaggtgggtgatcctgttggggccttcttagaccgactaagatcaagagtagggggtgttctattccacaatgtagttatcaatgctgcatatattgcctagcatatttagctgtctaggaacaagctggtttttgaatccagaatgacctcggcatggttcattttgaagagagccacaacccttgcgtcggagatgattgatgttactttgagttcctcggcaatctaggactcccactctgctcttagaacaatccgaaaggtgtttatcatttgggagtcctttcctccgaggtactttaaggtgaactttgatggtagcgttcacggcaggtttggaggtgcaggttttgtactctgtggatctgatttcagcttgattgccagcttttcaagcttttagtttcaggtgcggagcttcaagctgcttggactgggattgtgtatgttcgaaggaatctacacgtggattatattgttattaagggtgattatgccacggtggtggtatcatggatgcaaaaaagtatgcaagaagctctctctcattatatcttatgggacatcttcatcctgctagttggatgtggtggtctctctatccgacatgctctccggaaggccaacggtatagttgattaggttgcgacgttcgttgtggaacactccgatgaatttttggagactgatccgaggttgattccttggtctttcaaggatgtttcactttctgcctttttgggatgtattcacacaagatttatatgaatgttttcatttttattaaaaaaaaaaaatctcgggcatcctgtgagcctaaataagttttttattaaattttgaggaactaataaagatgtttaaaattatcctaaaatatggccgaattaacagactaagtcttttattaaattttgatgaacaaataaaagatttagtctcttagttcttgtcttccttatcccatttctttaatatttggactcgtagagtcaccctagaccgtggatgtttgatttccgtatccatatcattaactaatatgaatgtgtggataaacacttcctatccatccaatcgatacgatttttgaggacctccgcaagcaaggttgccaagatgcctcctccgtgtttgaaaagctatcaaatatttccgttggttctttcatttgcaacatccctcgtacttacatcttgaatttgaacttatcatctatttcaacggtgactcgtaaaacgttagtctctggagcccaatctcaaattttggacacacgagaggcaccacacgtcgtactctcggcatatttcaaaacaagtttattacctttctagaacttcttttttttttttcttggtagaaagaactttcttttcaagaaatgcttttctacctcattctttccttctctacgagaaaaacgttcgaaattgaactaggaatctaatgattttttttaaaaaaaattgttagaattttactttacaatttcctacaaaccgagaactttgggagcatagaaaaatcaaaccgaaaatttttcttgatattctttgataaaaccactctgataaatcattgattttattggttttgggaagagtataaatgctaacaaagaaaatttatcattattcataaatcaatttgtagcgatctatcagatcgatcctaataaggaaaacagcaacaatacaattttgcttctttaataatgagttaatcggtgatttccatgcatgcttcacattgtttcgcatatttttttttcccattttataatttatttttgatcatccaattctcttctcagcatcttatccattacccgcgcacttgcattgtttcctacaccggtttcctgtaatggcaagaacgcatagagaaacagagcctcgcacggaaggagacccggagctgtttgtacgtgcattggtagtttagacaaaaaatgtggcaagaattattttcaaatttctctcctttccaattcgtttttttataggagatctcccatgccacgatcattccagccatagcatctctccattccgacgttttatacggaacacctcacaaaaccttttatcagcacaagataggaaattatgcaaggatttctatttgtataacatccaggaagaacctctgtgattctaatcaaactaccacgaataaacatgtattaaaacatctaacttgtcaatcagcatgataacaacaaaacatgggaaggtaacagatctttactcctcatcagtgcccgaaccttcggaactcgagtctccttttgatttggcaacaccattagccaatttgctcttcttatccctcccatcatcttcatcatcactgtactcgctctcgtaatcatcatagtcttcttcctcctcctcttcctcttcttcaataccttcatctgctggcccttcctctgccacatggcccctagttcctgcccggcttctctttagaacttttagctttacgttcgtcttcctatcacaacctatccatgaatcgcacaaacaataggagctcagattatagttcccttctgcaggtgcctgaaacttgcccataatcagccttgatccattcttcaccttctcaacagcttccttcacggcagtacttatttccttcacacctgcacccaaactctccttcgtttcttgaatggccttggatgcagctgcaatggcagcagcttcatctatgaaactgaccttttgggacatccacacatcatttgagatgggatcagcaagcagcaaccagaagttttcctccttgtggaatgggtagtacggggcatgggggagggcacctattagaccattcccacgcctcagtgttacccaagcatacatcgtgacaatgtctccctcttgtataccttcttccccttcagtctcacatgtgatctcaactgtgattgaagggatcatctcaagtacaagctctacatcatgtgcttcagctgcagaaagccctgcagcctgagtcagcagctcagcacggtcctccacagtcatgtcccgtagctcctgaagcgtccgcactttctgtagaagatgcacagaatcaaaaattaaggattcacctgataaatgacagaaaatcacaaataatatggcttgagaaaattgacaaaaaaaatgcccacaattgatgactaaggaaaccgcagaattgtacattcatatacaacaataagactgcttacaacgaaggatgggaaggttttgattgaatcagattacaatttccaggtagatacatatcggtcactaacactgtagatggaaagctatatcgatgaaatttgctgccccaaggatcatacttcatggccggtagtacatggaattgaaggatttgattttgtagtttcaacacacaccatctttgtcatggtgctgattgcctcagatacatgcacccgaaggaatatatatcacataattaacgctcagaaatcaaaagcttcaaaatttaatttggagatcattgaagtcgccagcaatagagaggtcagaataaacattacatttgttaaaggtaaaatataggcaacaatctcatgaaaaaatttgaaaggtctaatatgcatttgcatccatgttggtgtgagtcattaactttataccaattcaatcagaaagggaatcgacatgcctataagctgaaacaaggtaaggttttccaattccacctaactaatgaatacattatatataacttagaagggtaagatgagtccaggaagattaggttattgtgcaggatgctgagatgatggagctaaatgttagataagatgaaagagaagtataaagcagtttctgggaattgttgcagcttcacagatgagtcatccagagaaataagtattaatacatgaatgaaaggtgctgctggggaagctttaggaatcaaattatatgtcttggtggcccttgtaatgcaataaatcctcttgaaatcaaggaacaggccatgttacaaggtctaagtctggtggacgaggaaggattggttagaaacattgtgtcctaaatcagattcatgactgattaatatgttacagaaggggctcatgacagaataggaacctttgttctccctaatgttcttcaaggccagccatgtctaccatgaggggaatcaagcagcagctgtccagcaggtgaagaccaacctagatctcagtcacagcaatcctattccagctaagcttctgttactcattcatgctgatctttttggttgcattttttgttagacactgagcctctggcctcccacaataccaaagaaaaaggaaataaaaataaaaaaataaaaaggtgctaatgacagagaataggcacctcataaagagaataagtggaaggaactgaggaacgcaacaatttcacagtagattatgtcagaggcaaaccagtagattatgtcagaggcaaaccaggtaaagcattttcagttagccaagttatcaggtggaacctgtacttggaatcagggacctgaaatgggtacttactactaagctttctgtctgaatctggaatgtgatatatactgattttaagatgacaaattttcctttccaatgaagaactgaggcacttgttctgaaatctgaaaagaaagaaactctacttttcaagggagttgtttgatgtcatgtgcacatttacctaacagacagagaagttgttaaacattgaatggttaataaaacaattgtggtcatgaatggttaattaaatcttaaccaactctttttcaaattttaaattaataatatatatagcagttagtatataaagctcagttaaattaaattttcagtgaagctgctaatggaaacagggcattgttgatataatctaatctttacacgataccattcagatgagattaataaacttaacctgacttctctaaattaaaagagttcattgcaatgtccattccaagaccgttacatggcatgaactttgtcctaaatatattatgtacaagaacacatcaagatgcataacagtctctatggcaatatgtaggagaaagtctcaaaagcaaatatgataattgattgctatcagtccgttggacaaagccatgccaacacctaaaattaagctcttttgcatcatgcaagactatacacatgcccactgacattagcatttctccattccaggccatcaaattacctataataatcatgaaattatatacttgtcaacattttggatcaatcttacctcttctgggagtgagtatgggagtaaatgtgtactggactggcgaagtcaaactctaaaaagcatttggaacaaggaagtgcctacaaactgcacacagtataggggtggcaactggtagggttctgctaacgtttggccatatccatccgaaagccaaagtacatatgtcagacccaacccctatctataatcctacatccatatccactgttggacataaacttatttgggagatagtaaacgcatgtaagctattatgacaaattatagaactgttttgttaagttaatcaaccaaaaatattaccttctgaacattgcatcatttacatcatgcagtggcatgagtggaatcctagggccaaaggtgaagaaagatgaatttgatagtttgaatttacacaaacagatcactttcttgactcaagctccacatattaggtcaagttcaggtcttagtgacatgtctcaatcctacctgagtgaatcaggcagttagcttggccctgctcaacttcaaatcagctgacatgttttcatgccaagcccaacccaaattaaacagatactgttcaccttggtctaatctacatcttgggtttaggccacgttcagttcaggccaaccaagcctcaagttcagccccacatgaggtcaaccatgtaaaagattaatcttcccaataattgaatgtcaaatgcacatattatggttaactgcattctacaaaaaaagaggagcaaaagatgttatgtactattgattatactttgtttaccttgcgggcaatttttttcacaactgtctcattgaaatgcgggagctgcaaaaattgtgcaatgccctcaggatttcctccagttgtttttctcgcactgagaggtacagcctgtgcattgtaaaaggattagactgttgaacagatcagcataagaatccagcaaagagtagaatcaaacttaaacaaatgaacgggcagaaatgctaggaaaacttgatgaatatagtgcaactattcagtggtcttgcaaatatcaatacatattaacaagggagttacccattgaagttaccaactagcagagaaaaaagtaaaaaaataaaaataaaataaaggaaaataagaaaaaaaacaccaattactagttcaacatgtcaagaattagacaacagagagaagtattggacacgacgaaggatgaggaaacaaatcttaggtttggagaaatcaataagttgaatacacctctcgagaattgaccataatcagatcaagctagtcaagcacatgtaaaattcaaatatgcagttccatcttcaacacttccgaaatattctgcatgcatgatatcatccagaaacgaacttcaaatgtaaaaagttgtaaattcagatgtttaatgatgttgatgcaacaaattattgtttggacatttaataaacaaccagcgagtcttatctccaagggtgaccctttgtggaacacgatttgatcctctagagttggattatattcttctagctcttaactggaagacaaatccagtcttggtattgtaatcctggctcagataactttgtgggaaactaggcttgcagtgaaagctaacaaccaacccttgcaggatgacctaacttattagtcacaatgttgaaatcatgcaacaaatgaccttcttaattgattgaggcttagaaagaatacccaccaaatgaaaagggaaaacgacaaggtttgacattaggaattgcatccatttctaaggcaaaaattatagatcaccaagccaattggaacaaaatacttcccaaaagtacctataattaacaatcagacgtttaaattgaacccaggtaaggagcaagaacttctaatgcacgatcaacatgagcctgtttacatgaaaagatcaccagaaaatttaaatagataaaatattcaaagatcctgattcctgaatggaaaataaattcaagctatggccccttaaagatttcatgatcgaatagttgactaagatcatcttaaaacctgtttacaaccatgaaattgacaaatcaggtacttgctgatgcaaatgttaaaatcatgtagccagaaattaaacaacctccagaaaaaaaaaaaattctaaaatccaaaacatacagtttcaatactttcatcaacttttacagatacactgtaagatacttgctgatgcaaatgttaaaatcatgtagctggaaattaaacaacctccagaaaaaaattctgaaatccaaaacatacagttacaatactttcatcaactttcaaagatatattgcattgcaacttgaaacgaccatagaattttgaaatttgaataggaattcaagaagagtaaggctctggtacaagctcaaataatcaagtcatgtcgccaatatcagcagcaacaaaattgagatccaccaaatgttctatctattttaacttctttgttttgcaaataaattcttcacttgctacagataatatgaatgtacagaccgaactgtagcatccatctgatgataaggcatacaagttaggattgttggaacactacttgtaaaacagtgaagaaagaaatttgaaccaaggtagcttttcttggtggttgctcaagactagtcagcttgctttcaagttcaacaatattgaaaaaccaaggaaaaattcacaaaacattctaatcacaggacagatgatttcttgatcactttgcatcagttaatccacgtagaagaagaggcaaccgaagtcagatgactgccaaagcatgaaggatgttacatgaatacatggtgcgaaaaccaattccaaaatttagtataggaatcagggaagtgttagcatttcttcatgctcattattccatacagcatttttgcggttgtgctactttttgccagatgctttctataagggaatatatgactattgtcaagcatgagaagaggcaatgctaaatgcctgtttccaggaaaaagatttcattatttttttcttttaatgaaaaaggttcacccaaccaggaggaaaatgaagaggaaaagtaatgatgcctccgcaagctaaagagaatagcttttgatgagatccataacaagcagagcataataccatttatctggaacagtgacatctatggaaaacattcagataacggaaaccacaaattggagatcaatgatcctgagatttgtagaaactacaaaaggaactattatacacttgaatgtcaaaatcagtagcatgcagaatacacatctgcaaaattgattaaggttctgtaaaatgagaaattgatattttcaaatcacaagtcaggttaaagaaagaagaagtttgcatgactagtcaaaattataaacatttgaaatcacattgtttcgttcttctttattattggcatgttgttttgtatatacaaaaaaaaaattgataggaaatgcaactaattaagcacctgaataatacactgagaaagctcaaccaccccaattgcaggcctcagccatccatgtccttgagaagtgcgtggtaatacagcgatctgcatgtactaacacacattaggatgcagtacaacatattctttggtaaaaaaaatcctagattacacaagtacaagataaatgtaaaagtagttaaatcaaaagatcagaaagttgtagaatgagcctgatggcagacatgtagatctagcagtacatgttgatcacttaggaaactgccaagcttttctcagacagcaggggcaaaaaataaagcaaagtgttttgactaataagatcaaattaaaatgttaaatggacttgttagagagagagagggagagattagttctccatgcagttcagaaaataatatttttttctatgagaagtgacataatgacataacactgttatcttgctgttattaattattatccattattttgtattatgatggtagaaaatctggtatgacatcgaatattttattcccacaatattcaaactataaggccttattcccacaatattcaaactataaggccagaagtgagctaatataaactaagaggatacattttggagaatctcacaggtaccaatgtttgtgcagatgtcaatatgaccaagctagtagaacaaacaacaaaaattttcttgcagtactaatgcaacttgttctatcatcttcctataaaaagggttggcattaaccacatcaccaatgcactagtgaagagaattccttgatatttccactttcatatctacttatgctttgcatgaagttggcaccatatataatgcaaggaaacctaaccatttagattgtcacaaaagaccagagttattaaaaaaaatcattcgcactcgcatgccctaaaaacttgagacacaacactgagttggacgtgttatacatgtctaagcatctaacacaccagtgaagagaattcttcttgacactaaccctttagttcttatgaagctttttaaaacaaacctattatgctcccatttattcatcattgcaataccaatgctctggagttgtcattgaattgagcaagtaatcttatatatcaagatcaataaatatcaccacagcttaggtctatgagataattatcaacttacttgtgttgcaccttttagcatacatgtcagacatgtcactgtcataaacatgtttgaaatcaaaagtgacattatcctactgctatgcacaatatctatactactatgtgaaggaaaaaggcaccctggtttttgtccatcccattttattttccatgtggttctacacattgaaaaattctacttgtaccctcttattatcatattccgatctttgcttctccagtaagaattaatttcagaacctctttttgttaccattatgtgtgtggggctcacaacgacagaaaatcccaaagagcacttatttttaatctctctcgcacagcctccccccaacttactctctctctctctctcacagacacagatctggttcaaagataaaatcccaaagagcttatatttttcattactctctctcccttagttactcattctctcttaggcacagatctggttcaaatattttggctttcagctgtacaattttcatatataaaatctttttttttataaactataaaaatgtaaacgtttcttgcttcattattctcaattaaatggtgtggtggatgcttttcaatatacagattatgtctaactcttagttttctctccacagaattagattgttttccttgtattacaaatatttcactccattttgtgaactcttaactaagaaacctccaacttgtgggaccttgtcatggtaaagtaaaagtgctgttaagactaagaagataggatttcagaattaaaatgttaggctctattaaccctctgatagctttacatacaaccttatataaattgagctgcatgcttaggcctttaaataggctccactactaagcctataaacacagcattaaattctcttgcagtttttgttgaaagagaagaggtccattttcaaatcatgggccattcatgtcttgcaacaggtgatagcacctgatgcaacatttatagtcttggctttgtccaatcacctattatcaaatgaaacttaatatggactagaccacttcagtgagtgcacagcaaaattcttgagtctcatcaaatgccggtttaggaactttatgcatgaaaaatgattgccccatagcattcttcactaggtaattagtgattctgacaccatgcccctttttttcactcagatttggcaggtgacttaatgtgaagtctcttgagagctaggaaaaatgatgataacattcatactgtttagcatttgatgctttattaagttgttaaaagtttcttaataaaactgtagtaagccatcttcgaatttcagataagaagagtaggagtgcaatcacggaatgaaatataagatgttagtatgttatctttgaaataagagtaggagaagagagagtatgataggttctaccattccttttctcgatatctagaactcttatcggtgttcattatttctttggtcgggcatctgagctaatgacaacaatggacagcaaggttcgtcgtaccggtaccggatgccgtatcgatgaaattctgtttaatgtcggtacgcggtttggtacggtatggtaatgtcagtacgcttcggtatggcgtaccgatacgagatcggtacggtatgctacgggcggtatgggacggtatagtattccatgatggacagtaatgaaaagggaaggacaatacctacattcattctcttctttttttttctttttcataagaagaactattttttagttttaatttgtttatttaagtcataaattgcacatatttggtgtcttcgttcctttagaatgctccgtgacttagacactcatgtacgattttaaaattttaattttaatttctgcatgccaaaaaccaactgtctttgctcatcaaagatagataatgttggactttgtgtggcgttagagatagggaacggaatgaaggcttcaattttcctatatcaatgggtttgattagtcaacttgccatatcttcatgaattaagggattagaacagttagtcaaaaaaacttatttgcattagttttaaattttttttaaaaaaaaaaaatttcacatgagtattccaattaccatttgtgcactaaattcttggaagaatattttctttttaacttgcaatacatcaatatgatggatttatggtgatttaggtcattaggtgtgccgatgattcataaatagcttgatttaattgcacttaacttttttatcaacttccaccaattcaataactaaagaagggttcaatatccttcattaggataaaattaaggtcctaaaaatgctatacatcattgattattttatactggtatgcagatatgcatttttgggccatattgtcaaagacaataaaaattcaggattcaaacaattatcaatatattagacctaggatcacatgatctatggagcaacaaactcattggtcaagacttgagaagaatatacttatcaagtgcatactcatcaagagttgacaaccggatctgtcctgcatgtatggttgcttgcaatttttgaatctcattaattgttactacttattagtaatctattcttaattgagataaattctcatacattgaaagataagtatatcatagttattatcctaatagaaattcttatacattgaaagataaagatatcataattatatcctaataggacgtttaataagtggagttctaaaagattcttgtatgtaatatctcaatcatgaccatgttgaggttttggctaggaaagagtactgaatgattctcgctatatgcatcaatgtttgtgaggcttaaagtatgcaacatcattaacctagtgtacaaacatggttaataatatttacgtctcttgttgcttaattttttttcaatgactttaacatcttacaactattttcaataattcaagtttatctggcaaataacctatttagctcaaggaacttttcgaagattatccgaatactgttcaaaagtttagataacgcaaaatatatgtaagagagaatatactatttaatgtatgactcaattacaagtcattaaaacttagataaatttattgcaatggaaaaatttcacaaacaacctggagaaatgtttgcaccaatatcctaatttgtgataatatgtacctgcttaaaaccattgcattcctaacagaataaaggggtagtagttaaagtatttcatgaagtggttcattgcatataatggccaccttttgaatgttatccacacctggtcgcatgcattacatgtgcttaaattaaaactaattatttagcacctaccaacaagagaagcatcttccaattatatagaacaataagagatgaaacattctaatcaaattatctgtagtattttctgttctaaactatgagaaagtatcatataattttggttgaacggaagtccccagcacccgcaaccacttgcctctctacatgtgatttggctcacaggttagtgttcgagcaacaaatgtagtaaaaagagtccagtttatttgatgtctaatttataggacaaagtctagtttctagagaagttttcagttcagtatacttcaaataccttatggtatggtatgatatgcaccctgtaccgagacagcttttaaccatttttctcactttttatctcattatgttttggtatggttcgatatgccttagtatgagtcgatacccatccgatacatcttggtacacctcagtataaagcctgcaccggcacaaacctgatttcataccagttcccacttggtatggtacagggcggtatgacagtccataattggaagcctaatctgagctagaaacaggtgttagaaaggcagctctaaatatcttttcttttaggatttgacgtgcaatatcaggactgctatgagtttactaatgaagttaaatattgcataagtaatgtatgaatgatattggaattttaagataaatatttttggcgggttacacatttatttgcctgcctcttcttctgcttgaacttatatcttacttttcttcacttgtctatcatattacttcatatctatgggtccatccataactaaagatataacagacaagagctacaagcttacaacaattacatgcacccttctttcatatattctacaactgcaactagctatcactatataagaagtgcagaaggctgtgctgtatcacgattcaaccgaaattccataaaaggaaataatctgaagaaaatttatccacaaactttccaccaagttgtggtcaaagattagacaagttaataatcctccaaagaattgctgtggctatgaaagaaactggaaggttagttagtcctaaaaattcagaacatagaaaaccataatatcagtcaacgactttgttcagatgatgaactgcacattataatcacaacctttatatctacattgaacagaagaagctggtaactttaaccatggaagaatatatacacataagaagtaaggagttaaagaaagaattcataatcaccttcactagttcttcaagaagacggggtgcaagttctagcatacgtctaaaatcactttgtagagccgaagataaagaagctgattcacgggttaattgggcttgaatcagcaattccatctgaaatcaacaaaaaaggactacagaatttgaaggataacatcaagtacaaaataaagacaagaattatcattattcttggtgaggccaatgatccaaggagatgtaagtgtttgatttctatgtcttactccttttgaactgcgtaggatgggctcattggcaaccacctgaattctgaagtataaatagttgttggaatgctatgcccttatgggctgtgaatgaagctaatgtgatcatagcgtgagggctgaagaatggtccgacagttgtatgccattacagcatcttcagcacacaataagatgaattgctgaatatagatacataatactaccttaactaatgacggatgctgcttccaaaactttgcttgctctgttttgatgttttttaggtccagattcaattcacttctaactgccacaaacagtttctgaaggggttcatcatcacttctacgaactggtatttccataaattctgcagccttgatgaagacatccacaatcttgctgtatcattatttatttcatcagatacagaaggaaaaaattagaaaacagcttctagaattaataagggatgatgttatgtggagatgttaatatccagaaaataactggatgctctcaagttacaatgtatctgtgcgccagctttagctaagtaatctgcgagtccctcatcacaacacctttccataaacaggcattatcaatgtcttattatatcaattctttggtggaattataactaccgaaaatgaacaggtggatggcccttgttcttaaagaaagcagtttcttggatcttattgtaagaaaaccaaatcacacagagagatgagataaaagcagtgttgccaacaagcctcaccaagacgagtatattttagataagaaaccaactttttgccaacaagacaaacctaagatgacattaaattggggttgaaaatcctaagtagcatgttcacaggtcatcctttgctagctaccttctaaggcattagcatcatttgcagaagctgaagtgcaaaatggtgataagtctaacaatcaccaatctctgcaacaaattcctgtaagaagagatctcatgctttattgatcaactacattatttccatcactatttttttttaaaaaattatcttaccagtcaaagagctggatgatcatctcaccagggttataaaaacaaacattagtcattttctctttcacatgttttctgctatttcacctaaaaaaaaaatctctcatttgagaatgtgttacaaagcacacacagtaggtctggacactgatgtattatctagatgttccaaattttgagtttgccaaggttatagatacctgaaatagaagtgacaatggattgggtattgggttgggtaaaatttggtttgggtcaagaaattcttaacccatatctgacccatttataattggagtggaaagaataacccatgcccaacccatttattttatatgagtatggaccccatagccaacctgccaatccaattagtgccttactagtcaattataaagctaaaatttgagggtctagtatggagaatacaaataaagtgagaaaccgaggagaaactgaaatgatgaaagggtaataaatcctcaatatgctacccctttaacatatcttcattatattttattcatttcctgatgatcaatttttcagcatttccccggctttgcattctgtgtggaagaagtgatgagattacatatcacttgtccttgagcgatgttacctcttgaatatttgagtattttgtatataaacttaacgttgaagatctgccaaaatcggtgggtaaaatatggaaggagtggagacagcacaatgttagaaccaattcccaatctagggtggatgcattgcctcagtactttgctggagtatttggattgaaagaaatgaaaaaaatattcagaaatcaagctacaacaatggagaaggttaggaagagttctgttttgtcttgttttcaattggacggctgctaccgctaagaggagtcaagcactacttaaacctgttctagatatctttaagtcggatctgtaacctttcactcggtctaatgtctcttttctactccataataaattggatcagggtctgcccaattctctctcaaaataattgcgtagccttcctaaccaaccaaatcaggccttgagtaggccatagcccatcacacaatttcgactactataaaggttcaagaatggattttaagagtttgcttcacccattgtgacccattaggttagacagtcaaatccataccccacccacttataattggttgatcttggctacccaagcccaatcaaattataaagaacctcacccaagcctatttattttgggtagttttgagtagatttgaccaggctggcaggtctacgttagaaactttgaaccctactatggcacacgcaacaactcatgacactcctaacactccagaccatcaaatcatgtacccattatcaatgtttacatttggcacttgtactgacagacattatagttatcaagtataacatatcctttagaatgtagtcaatttatgaacttaagaagtaggcccagctccctatgaatttatatacatcttttcttcaggagatcatataaccatctatcatgattagacattcatataaaagatatatgtgtttggctaaaaagcataattttttggaaatagaaagttggaacattaagtttctgaaatagggtgaccaaatgcatgagactcccaccgttgtggggtctgaggaaggtcaaagcatgcaagtttgggcccagcgcggaggggctatttttgtgtttcgaacctgtgagctccaggtcacaaaggagcaaccttaacgttgcaccaaggcaagtttatgaaaaatccatggagaaaatattgagaaatacatggcaatcttttatggaaatatgtactggttggttcctcatggtttcctgaatattctggatgtttccaataagttttgctgttccaggagcccaactgaaatggggttcctatccaggtttcacaagagatgttgatgaagagaggaaataagaatccttgtactgctacaggaaacaatgaacttgaagccaaaaagaggctgagaatatggtagctaaaaaagctttgatatcagtagtagttcccatgcaactcttaacaacaatgatcatcttcaatatgcaaatttcaaattgaaatagatttatttttgccagttcacataacatcttatgagacccattaacctgcctgagaaataattccagaccatgcataataaacagtaaaaagttcaagaacaactataatgaattaacactaaatataagtatgatttttatgcacaataacatgtaatccttattataatagcctataagaaaaaagttttagtttttggttcatatctttgtgagttctaaatattgaatcaagattcgcggactcggtattggaactcgtgccggccggccggcggtatgggtcagtacaaattcgtactagaccggatcggcgcgaaccgacataaagcaaaagaatcgaatcagaaggaaaaaagagaaagagagagatagatggggagggggagaaagaaaaggggggggagaaagaaaaggaggggaagccgtcggagaggctactatggccgcagaacggcgcacttgatacctgtggtgctgcaagcatgaaacaagggcgctcgctcctgtttcacggatttttttttaaaaatgcggattacggtgaaactagcaaacctattgctgacttcatagtttttaatttaaaaaaaaaaatcttaaaaagtgaggcctggcttcaccattcatcgatcgttttaaaaaaagccgatgagtgaacaaggatggtcgcccctattccatgctccatccgcatgttttccgctgcccggtgggcggtggccacggcagcgacccgacgcccttcgatagctcctccaccgttcgctcctccctccaatacgatcgctctccctctctctctctttctcgctcatttaaaagccctattgggcgatatcgagccacggaggcttccgcggccctctgatggccacagcaggccaccgtcggcctccgacggcgtcgtgatttctctctctcctcctctttctcttcctctcctttcctctccctcctccgatgaaccatttttctcagccgaaccattctatttccccatcggttcgactcggtacagggtgtaccagttggttcgggctagtacgaaattttatgtattgaatgattatattagattgccattctttttgacctcctacaacacaaccatttcaaaattatactttttacctggagctagcagtttgattcatttggatgatttttgaacccttcctccaagaagcccttacttgtctcaatcaagttttggtacattctttcgcctaccaccaccaccaccaccaatgaaccgctagagacacaccaattcggttcaattctatacacacctcttttatataaaattacaatatccttcttaggtttttcctcaaaatgatcctttctgaggctttaactatggtttttcaggattacaatctgttaggtacccttttttttttgttcttttaatgatacttgctaattgtcatacttcatttttggttcctgttttagttgacaaagccttcgtatgattcatcacaaccaagacctcctttgcctccttgggtttgacactccatttccatatttttggcccatcaagtgctcaatatttgcctccttgggttttggtgcttccataagaatgggcaacttcttgcttcctactccacataagaacagcttgggacttatggcttagcatgcaatgtcattttttttttgcaatattaaatttcaatatgatctagttacttagggcccattaagttttttgtacgttcattttagcctttgtagttcttgcaatcccctatgaaatagtgagatccacatgttgttgctagcctcacaattttgtcatcatatctttcctcgagtctggcctgtccatcttcctttatggtagatgccattcttgttgcacatgtttaacacataaagcatgcctacaatttgttggttgtctcaagtcaattgtctcactaatgtttcacagcataaaatgtggtttacctctccagacctagtatgcaagtactaatggacccccacctgctggcagcaaccaattcatgacaatttataggagcaattgatcctacttcactgtctaggatgtgcatattgctgatagctgtgtccagtaaggtgaactgcttcctgcaagataatccaattgtcctcccaccttcttcaagtatcatctcagtcacaccttactgagtcatccacaacgttgtcggcataaagtacaaaaagctctaccattctcatcctctcattagcagatgcattgcacaagccatatactataatttagtctctttaaaggcagactcttggcaatgaacaaccttgagtctgagtgcagagctagcacatgccaagtagtgtgagagataattatagtagcatatggtaatgtatacacgtagtttgtttattgtgccttttgtaatttcattctaaaatatgagtttgcacatgaattgataacaatattaatgtttatacaggtctattgcacttaatatgtgacttatgctcctgctaatagggagtgtgtcatttgctaaggtatatatgctggtaaattccccaatgagatttccagatgttttaacacttgacattcaaatgctttaagaatggcgatgcccactcagcaacagttcgtcaccatcacttaagaacacagctgacaaacttatgcaactatcattattggcaacttataataattaaattcagacagagtacaatacagatgaaatcattaaatatattagggaaaacatcaggtggtgctacataccttggagctaaagaaggtttcatgaaatagtagtatgcggacaaagtttgatgcatgacataatttccagtatattttgatgatcttgagaggtatataactgctatcaacaaaggcaaaagtatgcaaattccaacaatcccaagcaaaagtactccaccagatgctccatcaaaattcagtaagaactgaggtaaagcaattcccatttgaaatccctaaacaaagtaatataaatgatgtaccttagctcaaaagcaaatgctgaaaataatacaaaatttatagaaaattaagccttcaatcagatagatacaaacttgtgaacaaggaaactcacacaaggggaagttttacctgtctgccatcagggtggccatatttttcaaaattttcacgagaaataggatctgtcagagcctgatatgccttggatataaactccacaaagtacttatgggcctctggaacatcagcatgtgatcaaagtcggaataaggagaagcatccataattaaataatgatataaagatggtctaacatatggaagatcttcaacctggatcaggatttttatctggatggtacagaattgagagtcttcgatatgccttctttatttctgaatctgaagctcccggctctaatccaagaatgctaaatggctcaaatggttgagtctgaagaacagcagccaagccaagcataaataatcaaagcaaaatcatattggcatgaagataccacttatagtggttaagatgccttgagtgatttatcaacaatttgttaacataagttagcactgccttcatgttgttattttggatctatcacataaagaatagagggacaaaccaagatatatctactatcatataaagataattctccagatatctgcttcagtagactttcaatgttttcaacttttaaaggaatttttgtgaatatgtattatttttggatgcaaccaccttggtttagctcttttttttctttccttgattaagagaggaataagataactttgacaaccaaaagtcaagatgcattaatcatctaacatgaattgagatcacaacggtccatgtccaatacatatacaacaaaaggtttgacaaaggcatgtttcactaaattaaggagagttcattaaggttcctttgaagtgttagtaatcccagaatgcccttgagagcatagaaaatgtaatagatattctctaaaaatagatataataaagtggatatggggttaaaccaagattggaaattggtatatcagaataagtcccaaagttaacagatattacaaatggtaaaatggaaaaccaaatgaaacttttgaacagaagaaactatggtccaaggaaggttatgccaaggcctggtaggttgcgttaaaggaccatgaataaaaacagcaagacacaagagaacaagacacaaattttgagcaacgatgtgaaaaaaggttgaactggtggggctaaatttatgcaaagaaaaggttaaatacttatgaagattgattgctattaaaaaatctagtagtagttgttcgagaaacaagcaccacctgaggtattgaggtgacaaaaagtagatagctaaacacctacagcatcatgaataatacaaaaacacaagccacgcctcctagagaaggccatactcaattcccagaaacaccaaaaaataaacaaaaggaaaaaaaaacaagcaaaagctcagcaatggtccctggagtgggaagcaccagaaggcatacagaaaaggcagtggatggaaaaaggtgaggtggagtggtagtttggggagcaggagtgaggtgagggatggtgctgctagaggtggtctgctgagcagggctccagtttgacttggggcctggggctaccattgataattgtgacaaagatcccatgttgatgcaagtccattgctggagctgggatgcagctgtacaatgtccctacatagggacaagctgaaacccagtaccatgcaggttggtacagaaaaccttgtttttaacaactatgcaatccaataaatagtcaagtccataaaagttacggtacttgcaatacctcacggcttatatgtttaatgtaataaacaagaatccccatgatgacccagagcagcagaagtgtcaggttgctgcaagttgaaaagtttgagatctgcaaataaatcaaaagatatacattatgctaaaccaaatgtgacaacttccaggtataaactagaaggaaccatatatttaatatttacccgtttgaaaattgatttatgatacttccctgaatgtgaacatacagagcactggcaatgaatggtctttgtttttttagagacagcacggaataacctcagaattgtgtaaggcactagaggcagtgccattattgttaagatgaagattggaaacagagagctgttgtcctctgatgcagccattgatgccttatgatgttggcaagataaaacaactactatgatctgcaaaagggagtcaagatacataataaagagatgactgcaacttggcattaaaaatgaagaatgtatatctaacagaacagataaaataatcatggttgcaatcacaattatggaataattagctacaggaaaaaaaatgtctcttgcttgttataatttattgcgaaaaggacatgaccaggtataggataaaactaatacacaagaaaaacacctagaaaaataacaagccacccaccctcactagtagttggaatgtaacacataaaacattagatcgtgcacaacaaatcgatcaactcttctaacagaaatcctgttcctttgaccttcccctagagtatgtttatttctccttccaaaactccaatgacacttgcgtaagggaaacaaatctaacagcttcctttctctattagcaggtgaaaggcaacaagaacaattcaatttttacctggataagaaaccctgatatccttccatatccatatatatgccttacatcagtgtaatgagagaaaacaacttcatcatgcacagcacaacaggaacgttttacaagcaacttccactgttggttttaaagctggttgtatctatggactttcaccaagatcatcaatcaagagaaaattaggatttacaagggttcttcacttccaaactagattcttcagtccgcattagcgactgccactagtcaggaaatgaaactaatgatgcatccccaaaaatccaagctattctttttattttctatgaaaaataaataaagaattatcacctgtcactttcttgccttttctcatgcctaaatatcatgtcatgaatatgaatataaatatgtctagatatgtacgcatttacatcagtatgtattctgttaacctgaaagtctaaacaaagttagtccaaattgaaagaaaatgtttaaattcaatattaaaacaatacctataaagtccttgaaaagaggtcccaaacaatacaaaaacatctactagctgccactgcctaaaatcattgaagtatcaagaatttcatgatcataacacaagttgaggaatcttcaataacaggttgtttaacattaacatgggatgaagttcaattcataaacgttctcatgattaaatatccaaaatttgaaaagacggatcccataattaagtggtccaacaagatactctcaccaaggtcatgtccacactgagaaacatgaaggattcatgtcaagatcaagttccccataatgatgcaaccaatcagttagaagagacatcatcatattctatgtcaagactcaatattatgaccataatcaaccagaagagacaacatgagacctttatcctaatgtttagcttttagatgatacagaatgaaatatttctgatgatacaatattttcaaatagttcattcaccaattatctgaccctaagtttaaatgttttccactatccttctgaggtaaaccaaaaagctgaagattgggcaacatatgtggccacatgatgctaattaagacaagtatggcagcacagtgcttagtggactgcctttttgaagcataagagatatggctgcatatactaagcgcatataggcaatttggtatggtcaagtgaccacatatgcataagcagccacatatgcagcctcatgcaccgtatgataaatcattggcagtaattaaacaacacatcgatgtcttggctaaaagcagtctcatggcttttggaccttgatcagggtaattgatccaaaagttaaggctgttatcagggctggatgaccgagtcctttttccttggaaagaacaatattctacataagtcttttcatcaagattaataacgtactttgggtattttagtttaagttgcatgtctgaattttccaaacaattttactaggaacttgtgcgaagcccaagataatcaattgtatagggcgaaactaaaaactgatggattgatctggataaaataagtgattagaacagacctgaataatttatatacagtaattgaccatggtttcccttggctctactctataattatctttacagggaaaagctcctttcaactagagaaaagatctggttattcattgtacatttttcttttttttgttccagattttgtctttaagtcatatattcaacattctactgatcaaagcatctacagctggatcaacctgatatactcttcataagctgtgaactaaagtttctcatatttgaagagaaaggtgcaaatagagtagaagaccaggttgtgccagattggttataagaggttgacaatcttgaccatgatagtataagttgaggcacctaaaacaacatgatgatgaatatcgatcatgatcagaagctttacgtctggcaagagatgttagaaattaattaaaatgaaatattcaaagtgcaaggagacacaatccaacaatgggatgatttaataggagggaaaaacaacatcatatccagagaaagaagaaggattcgtgataagatcatccagtgaaccatctagaagggacagcatgacatttgaccctaacagtggtcttagctaatctagaaacaaaacatgtcttagctgatctacaaacaaaaatttctaatgactcaaataaacatgcaaaaagaggctaggaatcaaagagaagaaatcagccatgatgcattgcagcacaaacaccactcaaagattgctggatgatataacaggttggctaagagatcaagtccctaaagaaagaaaataaaggatgttcaaattccacaaatagatcaagtagattaggttgaagagcaaagggtaattttgatcctagtgattgttaaaagagaagatattttcaaggatccaaaaatctgaactccaagaatctaacaaagcatcccagatgataagatctcgcaaatctctacataatatgcagatatgaatggtgttgatctatgtttcttcgtccaagatggctagcttggtggattttgaacatcccaactcaatgtcctttagctagtgcagcgtccagcatcccttgctcttcctccaccattatgtttaggaaattttgtaaggcacactgattagaatctagcaccatacaaggataagcaaagaaaatcaaagaagaaaaatgcatcttgaccaaaccagatacacttccctcgataaaaaggaaaaaaaccagacacagctgtacacaactaaatatacaaacatattagcagagaaactatctagccacaagagaaggaagaattaaaggaaatatccttagccaactgtcagtttccttattcaataaagtttatacaatatcatcatctagccttaaacaattaattaggttattagccaaccaaaagaaaagcaatgcaatgtgtattgagggttcagggagttgaaagaagacccaaaaagacatatgaaaagccctattcttggacgcaccatcattcttcaaatgcacaagataagaatctcacatgaaccattataacaattgagaaaatgatcactgcattctaggtttgatggggaagtggccgaacggagttgcatttttttaaccttaatgattctttaataaggggacacaaagcctaccagcaacgagaatcgtagcacttggtacacacacataaacctgcaatttattgaatttcttcaagaacagcccactctttccaaccacaagttaaaatttatgttcggctggttgtgcatgatcactattgagggaccacgaacaagcaagacgtgtataagaattaggacgaataaaaataataacagtcatctaggtcagtcaatcaattttttttaaaaaaaatagcggacactttgcgatgcaatcaatctagtgataatcagcggaacataaatgttttggaaccataacataaaaaggtagtggagacggacaattgaatcgtgatcaaagaatcccgtagatcaagcccacaacctacagatgagactattagatccaaagaacaaaattcattgtcaacatccataaaagatccagatcaaaattcaatttaggacgcgcctaacattttaacctcgatctgaataattctgatccgaattaaaattcgatcctggaaactaccactcatcctatttcgaccgcctcaaaaagcgaaggaaaatggaaggacacaagggaacgcgtctttacctggcagccaagagagaacggcagccgagccgacggcagggagagaagaggcgggatggagctggtgaggcagcggagtctccgccgcggtggtgcggcagtggccggttgggagacccgaagctggaacagtagaaacacagagagagaagcggtggggaagggtggaggcgcgggatataaaagcagctttgggggaccagagctgcaattttgggaccggagtaggccgtgacggaattcggtagcgacaaactctatggggcgccaagcccgtcgccacagaagatcctcgtgcgcacaggtgatgacgtggcacttctctactcgccagtgcgccacatctggccaatcatttcgtgcaacgtcgcgtgatgacttttgcgtgccagcgctacagcattactcggtcagtggactggtaaagaacgtccaagtattagatgcaccaggtccggtggaccagtccaatagccactctccctatcatctcttgtgtttaaataatttagatatttaattaccgatctcttggttggcgccataacaataaaaactctccattgatcaaaattaaaactctcaaataaaaaaaaaaaaagaaggaagactcccaacagatgctgcacccgaaccccatcttctcctttctggcccatcctcctttctccgacgaccgcccgtgatggcctcccctcaccgacccatgatgcgacggcctccctccccttcccaacaatcgaaatcctttttttccctcccctccccgtcgacgatcgccctccctcccctccatggcgaccgcccgccagcaacgaactccctcgtcggcccgcgacacgatgcccccctctccccagcgcttgaaacccctcttcacctccccagtgaccacttaggatagtctcccctcgtcggcccacccatgacggcctaccctcgttgtgctccccattgacatcggtgttggccttcattggtccacagagaggaccatgagctgcgagaaataggtcgaaatgccctttggtccacgcctcgctcgatggactgcacgcaattttattttaaataataaaaaataaaatacataaaaaataaaaataatataataaaaaataataaaaaatataaatatataaaaaataaaaataataaaaataataaaaaatatttttgataataaaaataaaatatataaaaataaaaaatataatataaaataatataatataaaaataaaaataataaaaaaatttatcaattttgcaattgattttgaaaattaaaatattataaaaaaattatgactgattttgagatcaattttttaattaaaaactttaaaaataattagctaccaattttgtgatcgattttattaataaaaaaatatttttacaaaattagtgattgatattacgatctataaattaattaaaaaaattaaaagtacttatcgatcaattttgtgatcaattttattaataaaatttttttaaaataattagcgactatttttgcgatcgatttattaaaaaaatattttaataaatttaataattaattttatgattaattttataatcaatttttataaaataaaatattataaaatttaaattattcttcgtggatacttgttcatcaaatggaacggtcgttaaactaacataatacatagttaattaactatgatatatagtttaatttgaaggaaagaaaaattgtttctcttcggatagctcaagttgcatttaaaaatttttctattaatctacatgaataaggatcaaatccttatctaattaacagcggaatcagagattagatcttcaaaaatctgaaacagtcctttgcagagacctggatgtgcagatcctctactttgtatacatgccagacgctataagaaaacaggataaacttcgatcttcgcaacccaatcaaacgagggagaagatatactggtgtgacaccttacaccagcaagtgggacgcccaaggagggcccatgccaagggaggaggggcggcaccaaaggagagaggttcaggagaagaaggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatccataggtagagaccctctctatttatagatgaatcccatgatccaataaatataggactcctaactcaaatatgctttgaatcagtccaatactcataaaagaaggactcctacatgagatagtattaccatcacatatgacaaccaaattgcatccaatccctcacctacatgggacgtccacaataaggaagcttccaggtgttggtcggcccataagagaggggaatcttaatgcaagaaggatttctcatatatcatccaaaatgggtccgattcgaattcaattcgaagctggttcgaaacaatttcgaaaggctgtcaattttaaactctttaggacttttgtaccaaatctaacttagatttttggatccaattaagtctaattaatttaaatataatctaaaattaattagtacttaaatccaatatttcatatactccatagatcatatatcgaaaactgttcatctccgtgatcgaacttgaacctcatgtgtagtgctagctagacatagtcaactcttcaatcccattcgatccataacttaattctcaatcaagttagcttatatgttcaatcaaatcaagtacttctaaattagacacataaatataagctaattctttcctatggtgtttgacttgtgtgtgtgactccataggtttaaatactaagccagcagcacaggaaccgacttctgtactaatcgagataccatctagcaatggttcccgacgtccaaataggtcaaattatcataaaaaaatatttcaaaatctatacacatggttaccgtataattcattcttttgaccctgaatgctctaggatggtttcagattaactgtcaatcgagattacttcatctacattgtatttcaacctttcaaatccatctcatagattatcctgattaaggttttactaaattgaaatacagcgatacatcaactccaataatctgaagggatcaatcccattttgatctacatatagacttcacaagtacttaactatacccagtacccttccgtcactacattagaaatccagatagtctggcatcaaagcacagaattatttgcaagtcactatgatgatcttagaactgaaagatacttatacccatgtgcttcatgagtagttcttgacagcagaatgcttagcaggtgagtcacttgttcagtaacgatgtactcctatatcacacctgtatgttatatcagtgtcaccacagtccttgattaaggagataaccaacccatatagcacacaatgacttccactcgataaatgttagcattctataatgacgtatcatttggtcgcaaacatgtttaagaactatacgataaattctctctttatcatacactaatatagttctaaggacttcatcacaatacaagagttcaaggaagatataactttgtgatgaaaaaatgtcagaataatttttattcatttatcaataatttatatacaaagaagaactcaatcgtcacacgattgattttaggatacaattcccaataactccaacttggactaaagtcaatcggggcagtatcttatacccatcttccatttgaagtcatcgaacgctttgatcccgagagctttagtaaaggggtcggctaggttctcctttctattgattttctgaagctcgacgtcacctcggttcatgatctctcgcaccaagtaatagcgatgtagaatattttgcaatatctgatgcagcattgtattctgttttgcatacagaatcgatcacagtatgttgcttgaaattcttctgacaaatagctcctccattaagataaatacatagcttgacacgcttctgctgtcatcataatctgactgaaaactgaaatcaatatatcccataagtttcaggttaatatctctatagataagccattagtctttagtatttctcagatacttaagaattattttcgcaatcttctaatgcttctctcctggatcagactggtacctactcactatccctactgaataggccacatccggcctcatacatatcatgatgtatatgatagatcccactatcaaagtatatggtattgtactcatatgcgctctctcctcaggagttgccggacaatcttttttgaaaagagtaattccatagtctatcggaagatagcctttcttgaaattatccatgttgaaccacttcaacaacgtattgatgtacatggattaggataatccaagcaatcttctaaatttatccctatagatcttcattcctaggatgtaggatgcttctcccaagttcttcatgaaaaactatgatgataactatagctttacactctacaaagtcgggatgtcattttctagtaacagtatatcatccacatatagtacaagaaagatgactacagaatcggaagcccacttgtagacgcaaagctcttctctattcctaatgaagccatatgttttgatcaccttttcaaaatgcatgttccaacttctagacgcctgtttaagtccataaatagacctatttagcttgtacattttcgactcatctatggatgtgaacccttcagattgtatcatatacacctcttcttccagctctccatttaggaaagcggttttgacatccatttgtcagatctcataatctaagtgtgcagcgatagcaaacaaaattcgaatggacttgagcattgccacaggagagaatatatcgtcatagtcaataccataatgttgatggtaaaccttagtaattagacgagctttataggtctctatcttttcgtccgctcctctttttctcttgaaaatttatttacatcctatgaattttatcccttcagatggatcaattagtgtccatacactatggatctccatagactccatctcggactttatggcctcaagccatttctgagagtcgggcccctatataggtgatcggatcttcatcatttttgtcaaatttaatggaatcatcattctggaccaaaaaaatcatagtatctatccagctgatgcggtactctaccggatctccttaatagcacctctattggctccagatttgattcatcaatcaaattcaattctgtgtgtgtcagttcttccacctcatgaacttcatcaaattcaattttacaggcattagctctttcactaaagaactctttttccaaaaagactgtccaactgcaaacaccttttgttctgtagtgaggcagaagtagtactctttagttttctttggtactctatgaataagcatctatcagacttcgatccaagcttatctgtcttgaaatgcttaatataagctagacacccccaaactctaaggtgtgagagcaccggcttacgccaagtccatatctcatatagagttttatcgatagacttgctcggcactttattcaaaatataacaggcagtttcaagagcatatctctaaaagaagattgacagactcgcaaagcccatcatggatcagatcatatctaacaagatttgatttttccttttagatatcgcattatgttgtggtgctccaagaggggtccactgtgagagaatcctattttcttctagatatgtcagaaattcactagtgagatattcacctcctcggtctgaccgaagggtcttaataccctttccaatctatttctctacttcagcatgaaatcatttgaatatttcaaataattttgatttatgcttcataagatagacatactcatacctcgataggtcatctgtaaatataatgaagtagtagtatcctcctctggcacttatgttcatagatccgcatacatcagtatgtattagatctaggatatcgctggctctttcaccttttctcttaaaagatgacttagtcatcttaccaagtagacgagattcgtaggttggtaatgattcacaatcatctatctcaaggatatgtttcttgatcaacctgtcaatcctattcttgctcacatgatcaagtctacaatgccaaaggtaggattcgctgacattatctaatttaggatatttgttggctgtacattatactaacaggtcgtgatattatgtatatgccatattttaattatccacacataattgcagtattattcataatgatatcataaaaatcatcctttattataaacttgtaactaagtttggccaaaaggcctacagagatgatattcataaaaaaagaaggacaatagtgataattatctaacatgacactactggattagaagacaagctgtaaagttttcaagactagaactgaaacaaagcttccatctccaacattaaggaaccgctcgtcctctcgaaacttcttacttatctgtagtccctgcaatgaattgcatatattaataggacttccggtattcaatacccagatagtagtatcacaaatagagaaattacaaggtgttatcatataagtaccttgtgaagcaatagcttgcttctttatcttattcttaggtctgtttgggtcaagagtggatatataagcaggacaattttttttcaatgatccagcttcttacagaagaagcactctatcttttttctatcaatttttgatgatttactctgcttaggatcggtggcatgggatttctgtatctttttctttttttctctcctaaaggatcgatgtcctgtagataatcctctcactaaattcactaactccttctggagctggtgattcttctcaaaagtctacagtaatcctagtaaaccatagtagttcaccacaggcttcgtcattctataatgattaaaaaatggtaggtagaatttcggtagtaaattaaggatagcatcatcgcctaattgttcatgcaatggacagtcaaatttgttaagatattcaatctgctcaattatgtacagtacatgattggtgactaaagcctcttcttgcatacggacattgaacactacacagaagattttatgtctctccgcatcctttgagatgctgaaggactcattcaatatttgaatgatctcctctacctgcgcatctttgaacttacgactaagtttgtcattcatagctgccctcatcacacaacgtatagccgtacggtcattaagccacttcatgtaagtatctctcacggcacgaggagcattgactgtaggtttttcaggtacttcatctataaggatatatacaattctctcatgcttcaagacgatcttcaactttcgataccaactatcgaagttggatccagtgagtttatcgctgtccaacagcgtgcggagggatagtgtgttggccataactaaaaaaaaaatataagcctattagtatatgaattatttttaatcctgaagatatagactttagtctaaaggtcctcccactatttttatgaattgatagcctctacctccaattcgaaaattacattaattctttagtgggtactagaatccacacagactgcattcggatctgactgtggctcgaccaaccctagtatatccatgggtaggttcataatcaattattttttcaaataatttctagcaattaggttttaccccaggcttcccttcagcaggcgtgtggcacctccattaaacatcctggttaggtctaactattaacatgataacatcaagtgtatctaacaaatggatattcaaattcgagtgtggctcgatcaacctgagtattgatctgaaagtatatcatgatggtcatatgatgaatgataattataatacgtaatagacaccagatatgtggcgccttcaatacctatttgaaatattcgactcattatcacgcaccttaataggaggctatgatcaaattatctcataactttatcattttatggacctaataatttagaagatttgatttcattgacctaagaataagagaagaagatgacctacaagctgcaaatcctctcactaacttcatcaagttatatagatgtttaaacacaaactgatttaaagacacctaaatcagtcacactgattcaccttaatagcatgggtctgcacgaatagactagtgacctaatcaaaatataatttatcatgttggccagataagtgagatcagtggaaggaatgtatccttaactcaccgtaaatacatctaagtgaatagctcccaattaaaaatcacttgatcgaatctgtcaaacttaccttagacaccaactggttaattagtttcgatttggtccatcagaagattcgggctcaaccacggagccatgatcatgatccatttattaggatcaaacatatggacttgatcaaacttcaactattgaaattgatttaaaaaaattctgatttaatctaattcaatacttaattagctttagtcaatttctttacttgatctatatgtatttctaaccctaggtctaacccattaaaaagatctgattcaaactaatcctttgcctattaatttatgtagtgtcttaatgatcttcaattctcaaatctagatcattcaaagcttaattcaaaattgtgtcaaacatgtattttaatctgtagaactattctaccagcatttcaagtgaagtataccatatgtttcaactcatgaaaataaatttttataatatgttcaacaattaaacatatataggtatgatctaaacttcatacatacatctcatgcatcatgataatttttagatcaataccgattacattttatgtaacatgctattcagatttaaaataattttatatctgaattttattttattataattaattataaattattttaaatctaatctaaatatattttgattaaaataatatataaaaatttgttcacttttttttcttcatgaaatcggatcacaatgacacccctacacatcataagagaacccatcgaatagataaaagagaaattaatctctatgatctcttatgaccggatggtttagtgatctcatcaatccaagtactagactactaagatctaaaatttaatttcatatataattacatcaatatgtaattattgataaaataatttttatgtcatgaacatatccttgatcttattaattatatttttcatctaatctaattagatttgatacatcatatcaaatctgaaacacatcttatactgattataaaatattaattttagatttaatattatatagaaaagtaattagatgcaaacatgaatgtatgaggaataaatttctgataaaatctatttttgcgtagtgctgaattttgataggattcagatctaaatatctattgaaacggatctaatttagatctgaaataaattttacttcataatgaaaacaacaatattaaaattttattaaaataaatttaaaataaattttaatttacattattatttcatttaaaagtttagcaacagtaaaaattctattataacaaacttataacaatcttaatcaacaattgattaggctcatctaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcaataatagttaatttattattatttttaaaaaataattaaaaaataatttttatttattattaaaatcattgaaggaggggactcagactttgacactggagaggggttgtgggcgttcgatatagagttacgggagcagactcaaactcattatggactgagatgcctgatgtatttatgtctctcttatgtggcatcaactcctcaccaaattgactaaacagaaattactataaaaattagagtcaaaaatattaattttgaaaaataattttaaaagtataggccacagctctctagtgccccccccgcatatttttcaaaactatttttttaaaaataatattttatcattattttaaaaatataattatttttattataaaaataatttatttttaaatatttttaaatattttattttattttatcattttatttttttatttttagttattttaaaaagtatttttagaaattatttttaagattatttttagaaagaattatttatgaataaattattaattttaaaaaatataaataaaaaatataaataaatatataaaatatataaaatatataaaatatttttttgaaaggatgactcactagaaatattttaaaaatataagtaaataaataaataaaatattattattattatttaatacttatttttatttttattattttattattattattttcattccttctccttcccccacatgccacaaactcccccctcccccctgacggcaccgggctcctccatgcatgccacccctcgtcgcacctccggcaccacacggcagccccttgcagccctcgacgctgccccctggacacccgcaccgcctgtgctgcccctggagaccttcatcgccccctctccggtcacttgggctacctcttggccacctgcaccgcctttcgactgctgctttgtgccaccgcaccgcaccccaaccgcctggctgcccatgccgcctccagctgcccacgccgcctccagctgccctcggtcatcttcttcgtttaccccctccattcgccaaaaaaaaagaacatgaaatcatcggtccaagtggcgagaggaggctatcgcgggtagtcactagggaagggaggggggccatcgtaggtagttgcttgggaggagaagagggtgatgattggcattaccatgctctctccgaggcttttgtcgggaagaaagaaattgaagagaagccacgaaataggagtattcaatttgagggcattttggtcttattaagggacttaaagttaaaacttcatttgtaatggaccaagagttataagttgggtcaatagggattaaaaattgaactttggtctacaaatggataggacattaatttctccataattctcacaatgatgcctatgagataaacatggtggttgatcgcatttgttgagctcgcccctaacaggatcttgatacacaatcatcgtacctgtattacttaaggtagagttaaaataggtacaatatatgggattaatagatcgataagtgaagacatttttcatacatgtaaaatatattttttaggaaaaaagcacatggttacatcaaaaagaaaaaaaatatttttaaaaaagtagatggttatatcaaaaagaagtatttgcccaatacttgtgatttcatcaatctttaatttctaaaaatagtttaatactatatgtgtgtgtgaggggggggaggagagagagagagactgcacggtagtgtgtttagttccacataaatcatgtattggataggttgtgaatatctatgcaaggtagaatagcccaaataagaccctcaagatagctttttgggataagatctcggattgttgtgaataaatatttctattttctacaaataatctagtataccaaatatttatattttaaaataaaaaaatatttttattttgaaaatataaaaatataaaaataccaaatggccgcttgccttatacatataattataaaagttcaaatgcaataaaagacaatatagtatattaaagaaaagaaaattaaaataggtaaaaatatatcaaaacaaaaacaaaaaaaaaattattggtacctatttgatttgtgtttagccaacttccaaagaaagatgtatgagttagatatatatttaaattaagaaccaatctcaaactaggttaagtatgaatcacatcaaaatggattttgaccctattaaatctagatggacccaatttagtgctataaaaagtagttaaaaatctctgagtttagcttagttagggtgtaaatcatattcaaaggtagggcaaacataatataaagcattaaattttttatcaaatatcttatggtcaatacttatctagttaagattttggtcaaacttgataaagacttcctattatttttgaaattaccatttaagatctaccaaaatttttcccactgagagaaggaaagtagacccacttgaattgcaaatatcactaaaataaatgaagtttatagcaatagaatgttagtaacactcaagagcatctattactctaacgctttcttataatagtttaaagaaatattataaaaaatatataatataacaatgtttgatcaaaagtgtttttaaatattgttatatagtgatggcatcttataactcctataaaattgtatgctaaaaattttatgttagatatgtgctctagaagctaattgttggttgacacattttataatttcagaacaaaactttatacttataaattttttattattaataaaaaataatttttatttcaattatatttatgtgtccatgatttgtcttaaaaattaataaaaataatttttgtatattctcaagatgttgagaatttgagacatgcattaattaatggttagtttctaaatgctctcaattaaagaatcgtcatagggatagtgatcaatctatttgagattgatgcatggatcatctttctttcggatagataagtctcagatctgcggtatagagacactgggatgagagtgcaggccagtggttgttagggaacaacttgcactgagcgtgaccaatatgaaaaatcatttggatgtctactcacttgtcagtgttatctcaatgttgcagtggtgtgagtagtcttttgacctatggtgtcatcggctattcacagcaaggttactgagtttgactgtacgttttcttggtctctagccattcggattcttgctgtatatattgactacagtaggttcaggtttgctgtttggagtaagatgtacctagataaaatttatcgatcttgatagaaaataagaagtcctatacaatttgcgagattgagttcaaaaagtctctgaccaaagcaagtgtgaatactgaaaatttttttacagaattcacaaatgaactcgactcgagccaatcttgcatatgactgatgatgaggtctgacaaattttttatgatctctatgagtcggactcatgatagaaggattgaattgtatgataactgcacctacgagttcacacttttattttattgaattgtcactacatattgctaggtgtcactgatggattatgggactcatcggatgtcatcttgatgatcgatgaccctcaaagaatagagttaaaattatttcaatctatcaaaaagagtttcgatgatattgtgacggagattacaatatgtcttactactagatagaatggaacctatggggtcacacattaagagatttaatcttgaatttatcaattagacttgtgaagttgtaattgtgttagaatttattgaaatcctattaggtttaggagaaccatactagtacatcattaaatttaattcttctctgaacttcgattggatcaagtccatagtcttgaacctaacctaaaactatttggatttaactggacacctaattgtcagcccaagaggattggattaagttaattagttggttaaattatctcttcattatctttttatttattttctaatattatgtgtggaattataggaaagaaaagatggtactatgcctctcttttggaaagtccaaggggcaccaacctttgattggcatgaggaagagagagaggcccaacccctctcttgtattggcatagaaagagaaagaaagaggggccatgccccttctctcttgcatgaaaatcctaagagggcgtcaagtgttaggcaccccaactatctgtcctcttttatgagagacgcccactcagtctgccttatctgactggggcactccatctgcttgccaaactaataaatagattttttaattaggtcttattttttcgaagaaaattagattaaaaggtaagagaatttatgagataagatctaatctttttagcctgattggataatgatttggaatcaagaaaggcctatttaagaagatggtctcttaggattctaaaagattgaattttaagaattctaaactcgtcctgccatatctccttgcctcatcctttctccttcttctctttcctatgcccaagggttgggcatccatcttccacatgtctaagttgagaaggttttcttctacagtaaagaacaaagagaaaaaggctgcagttcaagggttgaagttgcagtcaagatcaatagttgatcaaaattcaaagaggtcaagatcttacttagagaagaaagatctaccatggaaagaaagattcaagattgatcttagtggatatctgtagaggccaaacacgtgtacggctcaagaactttcggatctaagatcatcgatagtgatgaattttaacctacataaatgtatagagattcactctcatcttttattttatttttagattatatgcatatttttatttctgagctcggataggattagatatgatctaatgcatgtggggttaaaggatttaatccgatttcttttcgctgctattcaaaaaatttttgaaatctatgcatacatcttatctgattttctaacactttaaaagttatcataaaaaatatataatattataaaaattatttgtgaatattattaaaattttttatgttatgatagtaccttatgaggataatattttctgattaaatagtaattaattagtaatatatagttttctagtagaatactgactatttatcattgttaggatttgatgcctcgagattcagcccacaatgagcccacagcgaggttcgcggcgaaaaacggagtccaacgagatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtataactaatagttttcatttctaattatttataacttcttttatgataaattatgttgttgtaagctgatttagattttttgcaatgataatatttaatcactaaatatgtatgtaagtttttaaaaataaatattatgtatatctaataaattttaaaagtaacgaggtttcagctagacacattgattgttatatatcctatttatatttaacatttttttaataggttaaatatattattttaaacttcatttggccaatcctatttactaaatagttacgtggtcgatcatgtcagataaatagtaagagaagtatagattgggtttggtttgagtttttaaatctatgataccatagttttatatacattaatgattactgaatcaccaatgatgcattacaattaatttattaatatagaagggtacataattaatatattgtacttactatggtgaaaaaagaatcttaaatgcttattggttaagagagagctagtaaaattaataaaattgattatatattatatttttaactaaaatttttgatgcattaaagttttttatttaatttaatctaattcaattattaaataggttacatgagttaagtcagtttaatccattatcaatgttacaagtgacacactactatttagtaattatgatttaagacataattattaaaaatttgtatggaaaccgatttaactaagaatttggaacactaatcctacatgatttgtatgaaaaatataagaaaacttaaagttttttatataaaatataatataaagtattaaaaatattcaatattaatagcattattttttagttttgttataaataaaaagaataaaaatttattgggacatccttcgattttagttcgatttcaattacacctcctatattttaaaaagtgtcaaatgaacctttctatttaacaaactattttaatatggtcttactatctatttctattaatgaaattgtatcatgtgaccttgacatgatatcatatttttatgaaatgataatgatatccttactatattgtaggcaataatctaagagtagttgaattgtaggcaataatttaagcggtctcagatttgatctgtgatagaattgtatatataaaatttttcacatatttaaaaatataaatatatataaaagtgttctatatttttttgccattttttatcattattatagaccatttttgttgtagtatatttaaatacatgcttttggagatgcaccatcaaagaatgaaaaaaggacctctgattgctacataaagaggtgtcaccattgagctagacttctttaatgtaggaggatcactggattcattgtgaattaatttggctacacgagtaagtttgaatgaggttaaaaagtaagatccattgcatcaaggacctaaccacaaaccctaacttctaaaggtcacaattttctcatatagtattccttttcagcattcaaagtgctaaattgaagcttaatagctgagtaccataaaattgcttttttgatagtcatttcatataaaatttttaaatttaggaactatttataaaggtcaaattataatagcccaatacttcataaattgaaatagagccatacttattatctggatgtcccaatccatgatcattatacggatatctaaatagacctttacttttttttcggtcataactagcactgaactcccgtgttgtggggatttaattgatagtaatgataatattatacattaaaggttgctctcaccaatcataattattatatagatttaaaatattttttattttttatcatactatttatatttatattttttatttaaaaaatataaaaaataaataaaatttgatatgtggcattgcagaagattatcctatagtcttacgtgtcaacatggaatgccattcctaatactcgtgtatcgttttattattattatatagatagatagatttaaaatattttttattttttatcatattatttgtgcttttatttcttatttaaaaaatataaaaaataaaaaaaataaaatttgacatatagccttagaaaaaattatcctataatattacgtatcaacatgaaatatcatctctaatatccgtatatcgctttataattattatatagatagattagtaacgagcttttggatgttgtttcatgggtatacacccatgcgaaaggtttatcattgtggctcattgtccatgcatcaatttccatttcaaagggaggagatgttttacgtacgaactttaccatgagggcataacaaagctataacatgaaacgccaagccaccgattagggtaaataaaagtagaataatagctctctctctttgttacacatcgtttcttggaaatatttatgtacaagacatccttccttgcccaactaattcaaaggcttgacataaatattagttaggcaacacctaccattaatttacaacattgatagtatatcaaagcatgctggtaacaacacaatatgcttatagaaagatggacgaaaaattttaattataacacttactctcatggtatatgcaacctgtatagaccgatctggttggaagctgtatataattgcaaggcattctaactccctttatttagtagaaaatgtggtgcaagactgaggaagctggggtggtccgggccctacctgaggcccagaaggggagccattgctaccaccaggaccattggtgctcggaggagaccccatgattgacttgatagcggcagccaaggctgtagtgaagttgggatctgctgcaattgctgcggtgactgtctcaaccattgactgctgccttgggccaaactgcaccgccggcggccccaccactccaggcagcagcttatgggggaggtacatcgatggcggcatcgagaacgggattgacggcagatggccccgcgagagctggagtggactcggggactgcgttagatcgagggtgatggtggggaatggggcggaggcggagagggtggccatggtggaagcatagggcacggattggaagaagccaccaggggtcatgagggagtctttgctggtggtggagccggagagaagcatggcggcagcggcggacgtagtgttggccatggcagcggcggtttgggggagggggtggttgtgggtgccctcgtaggtggttataagaatggtcttgtcctcggcacatctctgcacctgttgcaccaaaacaaattttgataaataggatggcctctagaaaggaatccaaataagttttatacatagaaaggtatggagaaactctatctttgcacaccaaaaactttagaaattttctagtagctaagttacggactagtagtgtattttcttgcgaaacaatggagtagttcatatattaagcataaatttttgtcgcagatcatagtcccactcgtaaaggcagtaaggaaaaaggaaaacctttacgagaatgtttagaagatatttgaaatcctgtcttttctttgactgctgcttttttttttttgactagtatttgatgttcagctaattatacacagtcgacatatttaatttctggacctagtgagcctggtggtgccgttaccaggtctatcctgattctgtatattggtgtctttggtacaagttgtgaataagtatgtacaaggctaagaactaaacgtacaattcctattaaaatcaagcaacgggaataaaataatttaatcaataagaatttaaaataaaaatatataatggtctatcaatggacaaacgtcaattaccaataatgctaattataaagaaattatcaagacttagacaggttaccgtgtcaatctgcgatatgatatatatgcgtacgtacgtgtgcggtgttggtggttttatttgagttgtgggggaggaagagagggggagagaccagatacagtggcactgaagtagcagttttaggctttagaaatcccacataaaatttttgactaagccctgatcaaaatagatagacttaattaaaatgctaatgatgacagaaatcaaggacatcatagtggagcaaacagaggggagaaataataaacaaaaagaaataatcatcccccgcattgcaaattaaagagatctcaagatttagggttgtctttttgtcgtcaaaatcaatagcaaggctaatcaccacggctggaatggaaaactcaaagttcctttgaattaagaaaccatatatctgttgtttgagctgtaatctgagactttgagcaatttacttgttaaacaaacatacagcccaagatgaaggcaataaatgaggcatctgtcaatctgtgactaacaaccggaggaaatttttagttgactttgacttggtgaatacacaaccaatggtgagagttgatgatctgcctcatacattgtttgaagtcaccctaacactttcaaaaacaacggaatatttaaagatgcctcacgaggaaggaattttgaaaaatagtttaaaatatccagaaatacataataagggaagattaacggaaaaattttcaactgttgatgaagacttcctatatgcaatgaactggccttataaggaagaatggtgagatatataggacctaagtaaccaaacccaaaatatgctgcggttatgcttgcttatgtatgtaatttaatgtgtaaaagggattaagcctacaatattagataaagtcttccgggattgcactaagtacaacaatttgcagatgccaaatgtaatttcattacacagataacgaaccttttgacaggatccttggtataagaagcttttcaagtagataactgctatatccaaaggcaagttttctaccgattgcacctacctgctttcgaacggggcaaccaacagccatggtgcaacgataataggctcgtgggcatggattgccctttgccatcttctgaccatatttcctccattgacatccatcagtaatctgcgggcacaaaaccttttgccttagttcacaactgtttttatgtatagagtaaatactgattgcactaatggttacgtaatgggagtctgtgtttaccattggggcatcagatcgtgcgcgcactgagactcttgctttgcggcatgggagctcagtgtcagtgcttgtgtcttgcattagcctcggattcttgttactcccccagctaggtgatctttgctcggagggaccatcatcaacaggtagttgtctcttggtgagtggaataatgccttgctcccttgaacctctgttgacgatgttgttgctcaaagattgtgattgttcttcatcttcagcaccagaatgtccgaagttctgcatgctagtttgaccacgttccatgaattggtgttcggatactgccaccggactcgatgtatcggtcttgttgtcctatggatggataagaaacatattaatctgttgttgtaattagaggtcataatgaaaactatcaagatgtttctaggaagacatatataatatgttggcaaagaaaaagaaagacgaaatatgcaatttggcctacaattgtttgttatgatccaaagcctattgtgctgatttgatctgaaagacacctcagatgagattcattaggatgatgctccatgatgcgcgatcatattaatatataggaagaaaacaaatcaagagaaatataaatccatggattacgtaaccatatataccagtacttctttgaccattttatttcatgttttcatgctgcaatgaaacatatggtgaatttgctcaaaaagaaagaaatgcacggtgaaactcacactattttactttagaaaattgtcagatagaacacctttctttggccgtatacaaacaatgcaaagagggaagtgtttctttgagaaagcaaagaaggaagtgtggaaatcataatttttctatttttccaagtcagatatcaaaatatttcaaagatgaacggcgaaagcacattgatttcttcaagcaataaaaatcctatttagtacgtcacatttgtttcctcataaaaagaactatgtcacgtttgctgttttgcaagagaagccacaacctaactaatgtcattttcatataaaataaaattacaaatatctataattattttcaagtgtacaaataatctccttttttttcttttcttttccagatatactcttgcgtctacatgcaaggatatttaatcgactatgtgaacataaatgaagagacaaggaaatcggaaggcgcctcttgtctagatgcgatttatatatgctctcttgggcttttatggtatcaatttctctgcggtgaagcagataagattttcaaaaagagaaagtagaagaaacgagagtgagatcaaaaaagaaaaagaaaaagaaaaagagagagagagaaaaagaaacctgtccatgccggaaatcctgtgcccgttgttgcatggctaaaatatactcgttgtgaagaacaccataacttctagtgagctgctccagcatgatcctcaatctccggttctcttctcccaatcggtttagctccccttgaagcatggccagctagaaacacatataattcacgattgatccctaatcttacatgaagaattccatcttgtcgaccaaacaattagtcaaagcgcaccttgttgttaggtttcttctcctcttcagctccctggccaacccgtgagctcatggtcaaaagatgcaacgcggtctgccgaagaaaagaagaaaaagcactcttagcagtcagtctaacaggttcctaattaattatatatatatatatatcttatagaagagaaagcagtggtatggttatcaaaacatgtcatctttccattagaactacaatagaggaactcgatttatatcgagataagatttgactgcccaataattcaatacttacgttgatgcttgtatcttcctgaggtgatacgttctcccctcggggatcatgcgaaacaccagctcgtgcatcaccaccatggttgtctcttcgatggctctccgagaagaaatcgacctcttcgatcccgtctctccgatcgataccctcgtcaacactgcaaccacgctcatgactcgagaagctgtcggaatataagagtgccatttccttcggcctctccattggggagaggaagaagagggagagaagaagagagggggagggctctcaagaggtgcaagaaacaaaacagcaccaagagaagaggagagagagaggattggagtctttgaaagaaagacggttcgggccaataaatggcgtgggcagaggtggaccaggcgttgttttccgtggggtctaccccggtgacgtcaactttgacgtcggcgtgacagctggcgccgtatcggacccgtcagcgctggaaacggcgggaacggagaaagtatcccccaccgttagatctgacggcctcgggggggaatcccacgggtggcggggtcaacgaggtcggcactcgacggcacggctctgcgacggtgggtagaggtggggcccgccggcacctaattccccttgactccgtggagcaccacgtcgcctgatagggacacgtcgtcaggggagggagggctacgcttgctgggccaatgctttgagagtcgtgcactctcatatatgtggtgccgttgttctactccagtagctatggaaaataatgtttctatcaacgaaggggaaatgtacttgatgaatcttttattttgctggaaaaaaaggcatgacttagatatatctgctcacacgtgcaggcaaaaaaaaaaatctatatacacctatcaagcaactatacaagttggaaaaggtgtggacgttagtggactcatacagctttagcgttttaccttcctcctccatccccaaagagaaatgactttcttcttttaaataagttatccaaacttctaccaaaaaaaaaaacacaaaaaaaagtatttcaaactagtacccagaaaaaaaagttttccaaacctttatcttataattctttgtccttcttgtcttgtgttttctgttttcttaaagacagctatagtaaagaattaatcttttcttttattaagaaagagcttcttatgagaaaattttgaatgatttagaaaatcaacaatttgttcattccaacaccccccccccccctctttttttttgacagtaacttatttttatgtggtgaactagattaattatgtatggtagaataaattactattaggtggacttatcaattcaccaatttcttatgattatatttcatgacgttgatataaagcacaacattttctagatgagaatctaaataagttgaagtctacaagccaaacctattgtctgcaataaatttcaactggatgcatgtgataaggaaatttgattcgggccagttttaacgaaatcataacttcacatcaacacccagtttccaaatggtcatatataaaagggaaaagcacttaaataatttcaaaatttttaataagatattaacttatgtaaataattttgagttataaagcatagaatgagtgatatatggactttaagtacaattttttcattttttttatcctcatataatgtttattccaaaatttaggcttgttcaacacctacacattgagttgaggcatccaaaagatgctaccgatcgagcactgtcaccggcttaaccaaagttatatgtctaaataattaactaagtatatacttgttatatatagtgggtaagcattaatcaaaaggaaacttacctaacaagtgtactttgtgtagcacaattgtattttaatgcatgactcagatcatgaaggattatttaaaatggagaaaatcatttcagatggggagatttacaagggatgacaggcagagccttctttcctattaaagtcttggatagagccatgaggcgcacgtttgcaccatagtttaatgttatcaaacatcccatcgatgaaccaagaagcgaaagttgggtaggacgtggaagaagggagaagagtacacctcctacttcgtatatttgtgagatggcaggtactcaaatatatgcatccgttgagctagctagttgtattgttatgtagtatatatatattattattttgtaagataactagcatgacaaactaaagaaaggcaggcttggtcgtttctttacatgtgaacactatatgttagtcaatgccatctttatgaagggcatctactttccccatcaagtgaagatgacctacgagaccacctccaattcaaaatgacttacaaaacactatatactagtcaatgactatctttaatatccaatacctaataatccaaaatgtacaattcaaacattagctcatgcttgcttcttcttctttctcttctagtagaatggtactgaaacagatgctatcatcataaatagtcctgaatgccaagcaaatcctgagtctgagtgatcgggatggaatagggatgatgacccaagtgccacaatgattggatgaagccaggaaggaaacaaaatgtgatcaataacagctctacgtacgtacactctcttttgctataacatagtatctaagaccaaccaatcgataaaatagagggcattttatttataaaattattatatggatatgataatatattctaatattttaagtatttgatttgatataaatgtcgtaagactttgttgcacatatattgatgacggcgtacataaacaattgtttgaattattcaaaatgatgcaacatttaattcaggtaaaaatagcaaacattattttttttgtgattaattatttctatattcaggtatatggatgaaacttttcggttgtttgctactttcatgcattttcagggttttcagctttgataatacctacaaattaataaaaaaacaaagaaaaaaaagaaataaccatagatctcaaagttttcgcactgcctgtacgtcttcctgtatatattatttttattctcaattttatttccttgagacactccttatacgttcctctcacatgtcataatataattggtgtatggtagtattaaaactgtgaacagtagtattaactaacatgcatattagtattcatagaggtttaattgataatttgaaagcaattaaccatcctatttggctatatatgaccctaaagtcagtcccagaatcacccttatgcggcatatacattggactaatcaagattagattgcttttcgtgcaataatgatcttgttgccaacaaataaaacaaccaataagtccatttttgggcacttgtgggagagtcatcaaagtcgatttgtcgaccaatcttcgaattttgtttgcacgtaaacgtcgagctgataattgacgagggtcacacggactaattttaaattagacttttaaaggaattagttagtgagtccttagcgagtgatagagatcttaaattaggcatcacaaatagctaggccatatgtagcttctctggttcaatattgtgatttgtgatggattcagaagaagggggaaagacccacgggtatggatggtcctggggagtcacatgcgacgtggttggagtcaagcagtggagccaaaaagctaacgaggagatgaaagctaagggagggaggacaaaggctgtggtaaacgaaagcggcgcccgagccggcactcaaagacaaaggggtgaagaccacccttccatcgagaggggcatggagctggatgagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcatggagctggatgagagagagagagagagagaggtgtttggacttatttgccctctcactggttcccgttccatcttttctggttttgaaacgagttgaatgggctcccccacatacgacctcacgacgtccgcatcatttggacgccaaaggataatcgcacgaaatttgcatgacgcatctactttatgtcctccttttttttttggtaaaatagtggaaggaaatttcgggtgcttttgtatgggctcgttaaatttctttatactgaccgatgaactttctaatcgttatccataacaagtatctttctaaaatattttagcaattattatatattatcggtcgttttggtcaaatgtattaacatcaggatgatctatatgttagatgagatatctattctttcacacaccttatgttgaaaacctaaaggcttactttgccctaattatggcaaggaacaaagataggatctcttctcacttagatgtcctatttcttgggagaaacaagtttaaggtcaaattatcttgaaacacacatctttgaaattatgtaaagctaggatttcatttcggttccatcactacacctctcagagcaataatctaagacttcagctttattttagatgatttatccttacgaaaaaagcattgttgatatttcaatatgtccctatcatttaactctttctatacatatggacacataacatacatacataaatatgtgtgtatgcgtaaattagccaattaacattaacaacaacggggaacaaatatttcagaaatattagttaccatcataataaagctaatttcaaggaagtatgtatactagctttataaatttagaatatgcattttatttattaagaattaaggtgttaataagtaagtatagtatattcaaagaggtgtatgcatgggatctctttttccctttttagaaatggcatggtgttataggcatgttcataggagcaccagaacgatgtcatataatttcaagattggcccggattatcatatataatcttacactggtttatagtctatgagagaacattagaatgtagtagcaaatgattgatccaaattaacactatttgattgatgagccacactcatgtgtgtatgtattggacttcgaaagatttgttctatagatttgtctgagttagttcatcactctcttctcaatgaagaggctttaaattcaacttaagatgatggtaaggccaccctagctctcgtaaaaaaggcaaaaatcctataaggtttaatagtaatattttgaggagtattttaaatacgtagtcccaccttggacttgcatgtaatgatgagggattgtggactagctttttttaatttttattatctctcctattgatgactatactatatttttagagagatcaaaaattaaaaaaatcatggttgatggaccgcatgctaaaatgttggtcaatcgagtattttgttaaagtccgatcctagttattaaattttttttttaggaagacaggattagcacataatgatgaaaaaaatattcgttgtaattgtgataccacgacaaatcaattataatctttatatttcatcgattattgtgtatttcatcaatttttatgaattatactccatactattcctatgtatttcactcatttttgactctttattggtgattaatttgttacaatggtgacgtggtatcaccgttgctgtgaatattttctcacgacgatggctcaaaggaacacaaattaaggagcggtatttatttcagttatatattttttcagctacgaaatattataataaaacttttatgtaaaagggtcttaaagtctttccagcatttggcagccgttccgtgtgtaacactcctacgtgatgggatgtgacaaagcgatgcttttgcctttatacccttcctttgcaccgttgcgaagggttcaagtatatgataggtttccagaagggagaagaagtcacaagtggttggcccacgcagtcctctttttcttaggcgtttgaaatgcgagtgaccctggaaaggaacttctctcgctttgggggtatcccaacctcccaagcatatgactttgaaggctctttgaactcacatgtattcttttcttttctattggcttgcatgcaaaaggacttgacctaccattggcttggcatattgcatttgttgtcttcaagccttttgtctctccttcgcgttggtgtcaagaaagttaacatcctagaccagcatccaccaccttatttcttttggaagaattcttggtgactatatttaagccttcattgactgcccttgattttttagaaaattttagacagggttcagactggaccaatcctctatatatccttttgttcaagacttgcaaaaaaccacaattaaagtgcattatgggctaaataaatacctacaaaatcaacactttcattcattttcagcatttataaaggttgtaatcatacctgtatctttcttgtgaaaaagatgaaaggcaagatataagccatccggtaatccttcataaatttatgaataatctatgatcggcccccttttgatataaaaataacttggatgatcattcatgtgaaattgtgaatattttcttttgagaattattatccatgagtagtttgttatatcattaatttagaaggatgatcagacttgatgtgaattattttgtctactatggataaagataaatagattctactagtaagatccaccatatcggaaagtcaaacctccagaggttataattggatgatacaatcatcgattaagatgatttttttttaaaaaaaattagatgactttttaagacctatgatatagcactattctcttaaatgggctacatagctagtgattagatccaaatttcattgtttgggcttctaaataggccgatcaaatcaaaaattttattttcagaaaagattatgattggatatatctttcaatttagcaaaaaacagatagagtgatagaaaacaaagttgatgtaggagtagagatttatctctcgtaaaattttaattttttcattatttatttatactagttaatatttttttagaaagttaattctattttagctaggagaggaatcttttttgaattgtacaagcgatcttgcgattataaataagtggtatataccttatttttaaatcatcatcagcaaaagaaaatgggatctaaacctcattttcactacttttttcatttttttttttgtagaaattcaagttgattaatttgctagaattttttttttctccaaccggatcgatcattctcaatgatacaaagattgttgtttgttcagaccgactattttccatgatggttatttttaatgtaatttgccaaatggctcgcatggatccaagaaaaaatcaatgaacgtcaccaaggacaaaatgaaggctatatacagagtcgaaaaataatattggaaaggacaaattaaaagatggtcatttgaggaaccaatagtttggaacaggtgaaagaggtcatgaagcgtgtcatggactcctctttgtggctttcaagggctattgcggatgcaaattgcaagaagatctagcgaggtggtctggtcatgaaacagagctggtggacgtttaacatgtggtttggaagcatctcaaaggaccacaagggctcgttattcttgtcaaacaagaaagaacaagtggtagggggatggatagaggcctccgtcctctcctcgtctcattggcttaattagtctcctttctgattaatttccttatcctcatagctagctgctggaccatgaaggaccactagtgtgccacaatctattcagccgtccccctctatctctctctctctctttctcatattcatggagccatctctacctgcttgaaggatacagttgctcaatttttccagacgtgtccactcacctaccatgaccagcgtgtgccaagattcatgcacacatgttagcacgcaagtcatccaaagcacgtatcttaatatatacgaaggaagagcagatagaggtgtgtaaccgtcaagaagcatgcttgctataatttttaatggcttgtcatgaacatgattgatctctaattgaagttaatgaccccatcaagtgcccatcagaaatggtcatcacatcgagttatagtgcaaggattagtttatatcataatagaacaaaacatacatccttttcggaccagaatggcctgtagcaatgaaacattggcaccaaggtggtttctgttttttttttttcctgtggacctgagatggttttctgatataacaaatgtgtgggtctaagatgaattgaagtgagatggagctgcaaggatctaggtatgtactgtgatggcatcaaacaggacccatgttgtagaaaacaaatgtgactacttgttcaacgacttaggattgccaagaatttctatggcttttggtagttatgatccgatttagccactgagtttgggggatccaaagtccggtcatccagaacttagtggcctgttaattttagttcatggcctgacctatccatttggccaaagatatatccttcaccatgaggctatctcaataataaacagtagtagttaagtccgctctctagctaaaataagaagctcgtctagcctgattcaagcctaacctaaaacttaaagttttggaatacgttttccaatctaatccagtttgacggatataatgaaaattttgcttaagcactaccagttcatccccttgtcatccctacgactaaaagtggaaaaccaaaaattcagattagaaaattctagctggttgcataccgaaatggatggccaaatttctcaataaattatgttatgttggatttagaggcatctgtcttacatgaagaacatacgcaacccaatatattggttgatttgtcaacggagatctaagtccaggtctgtgttgggccaggctaaggttgactaatcattagttttccagactttctgaggagttatgtaatctctgaactgtcaccctaaagaggctgtgttattctttcttctcgctttcataaaccaggttgctccttgagctcccttccaatccaagaagaagaagaagaagaagaagaagtttattgccaaggggttagagggacaaatacacctaagttttctgaatttccttgcggttattttgttgttagtttaatttattagaagaatgctgtcttcttattgcaattctctctactgttggcttgcttattatagtatttaattaaatgacctgatcagaggttcgagtcaaggaaatgatatgttaatatgttcccgtgatatttacccattctctaatatgctgatgattctcttatttttgccaaagcaaagagagaaaatatttctgttcttaagctgatcctttattgttttgaattgatcactggtcttgtcattaactatcaagaaagttctattgtggttattgggccttcaaatagtccagcatcaatctttgcctcctggttaaactactgtctctctactgtacctctaatttatcttggactgcctctcaaagaaagtcggctctctaattctgactctctaattctgattggatgccacttataaatattagatgtatgtcctaaaaaatcaatatggtatgatacattataatatttttaagatatatatttgtacttaaatattgaatcgtcaataaaaaataatttttttatccatttttattaatgtgtccaaaaatcatcctaagaattaataatttttattaattcttaaattactcctaattgatggatcattacggagatggtgactgatccggttatatcgatgcatgcatcactttcttcggagtagacgagtttttagtctacagtgtgggaataatgagcgagagtgcaagtggttgttagagaacatcggtactgagtgtgatcaaatgagcgatcacgtggatattttctcactcgtcaatgatcgtctcaatgctgtagtggtgtgagtagttttttgatctgcggtgccttaactactcatagtgggattgcagtattttgactacatataaatatggttccttagccatttggatctttgtagtgtatgttggctacagtaggttcattataacagtaggatgcgcatttagaaaggatctatcgaccttagtagataaagagtagtactatgaaatttgagaggctgggtccttaagtttgtggccatagcaagatgatagatggaaaagagtttctatcggtatcatgctttggacttaagctaatcgaatttttcatatgatgaatgttgtgatttgatgagttttcataacctccatcctatcaggacacatgatagagaaactaaatcatacggtaactatacttaggggttttaatcattctattctactgaattgtcaccatatactgctaggcgtcacttggatcgttctggattgatgatccttgatagatgagagttgaaaatgttccaacccattgaaagctgtttcgataatactatgatgatcatggtatatctcactagcaggatgaaaactataagatcacacacaaaaggagtttgattaaattaactagttggatcatgatctaaattatcaatcactggatcatgattgataatttagatcaacttgtaaaagttacaagcactggatcagctaattgttagctaggaggatctaattataaatgttgcaatccaatttgatgaggtcaagttggaaaatcaagttctaattaattgaatcagatttaattagtttgggcttgacctaattaagtctaattgggcttttgatttcaagattgaatcctaattagattaagattaagtctggatcaggttggactcgaattcgattcgaattggattgagattgaacccaaaccacagagctccaatggactgggactctctcccttcctctacgccataataggggtgccaattcagattggcatccactccatgtgtgacaagaaggtgaggaagagagggggtgcaaattcaaattggcgcccctttgttgatgagctttatctcttgttgattagctctatcttctctctgatcaggataaaattaggtttgttttaatcttaaaactcttatttgataagagtccaagatcatccaaactctatccaaacccccttggctgccaattataaaaggacatgggtcttgggcatggagtaggattgagatcatttctagatctaagtgctgccgccccatctccttgcttccaccctaatccacatgccccacctcctcctggtcgatcaccctagagaaggaaagagagagatcagcgagaaaaataaagaaagaaagggagaaaggagttctcctgttgtcttccagatcctccgattttgtgtgaaaggtgttcgcgtgttgatccgcgagtcttcttctatgacagtcgaagaaggagattagatctaaacttgaaggagtaagatctacaagagagctagtacctcggggatcttggatgctttgatctactttagccttatgtaaatatctgtagaggccagacgcgtatgcagcttcaacagaacctgcagatatcctcagatctgacttgaagaaagagttttgtgccacagatagatgatttggtcatcaatttaatttttgattattttattttaaaattatatgcatactttcattttatttttcatcatatgaactagatccatagatattagattagatctatgcatgcataagttaaaaattattttaatatatttttttattatatatttcaaaatagttttaaaaattttatatgcatgacacctcaaaattcaatagtagtatcagagtcacgggttcatatgaataaaaaataagttgaaatctgatttccaatcagatgagatctgatttccaatcagatctgaagtcatatgatttaatctgaatttatatgattagatttgaaataaatacatatgaaaaatattttcataattagatctgattttattcgtgcatgagatgtatgaatattagtttagatctgatatatgttaattagttcgatatcgatatgctataagattgtcttggcataaagtttaccccttatgttggaaagattgttctatattgatattgaacgattttagatttaatctacaattatgtatgagatttatgatatatttgaaaattaattttgagatcataaaatataatttcatgcaagtaatttagatctgaaattgagaattaagatctaaaatttaagtaaatgtattattaattagacatgggtaaatcaaattaggtctattaattggattacatccaggactttcgaatttgaatataatagaatccgatcgatttgagtagttgatcaaatcgagtcaaaaattgattaagattagatcaagagttctcaggattaaaataatagttgtagttaatcaagtcgattgatatctatatgttaactcgattgacccaaagatctaattcggctcaatggctcgagtttgaatcacttaagctaatctatttgaaacccattgactaattggtatctaaggcaaatgcttgaaaggtggtgatgaatatttaatttaagatgctagaggcactaaatattgtaagtaatcattaatattattttattaaaaatttaatgctatctagtctattttacaggtaatcgagagtttgaattcatacgattcaatttggactcaaattggttcagatttgagtgaaccaagtaatcagctcttatttcagtgtgaacgcaacttaaagatcaagagtcaagaagcaacctccccaatcaaaggtccagattaaaagataaatggaactaagtgtgaatacgacttattaatcaacagagaagaatcaatatgaagatctaaggatccttattcacactcccatctctcttttcatgaaatcctagcctcctcactctataaatagaaccccaagacctttctctttttcaatcaagccaacgtctaaattcttttcaagcttctctctctctctcttcctcttcttcttcttcataagtctaggggagatactaatcctagcacaacatattcctccatagatctttttttcacatcctataaaatttaggagaggttctaatcctagtgctgctatcctttctctgttacatatccgcttccgtcaacctttcttccttggagtttctgtaccaagtctttcagccatcctatcgctgtctgcacggagaaaaatgaaggattcaaggagacacatccaccatcgggcgcagcaagaagatcaacttggtttagttgtcttgtatcgtaattttttttttttatgtatgcttctttataagattaatgaaaagtaattttatttttcatgcttctttcttaattttttttataatttatttttttttatatttttaaaataatcaactaagatccctatggatatgattccgactcactctatctacatagtagtgagtagggttaattttggtgtgctatgatacgcatcaaattttggcgctgttgccagagattttggcacgattattttgaaaaaaaaatttcaaaataaaaaaaatattttactactttctagatttttatttcttactttagattgcttgattgctttttatttattctttttcaaaatttctacctcatattactcttcgtatatggtagatttactattttatatttagatttctttatttgcatgcatagaaatattttttacttcctataacctagcaatttactactttttatagattagaataatttactatttttatataattagagattttctacttcataaatagattagattcttagccttttatttggattacatagttaccttttattcttaactgtgagattaccttatttgcatagttaagtagttatcttatttattattgcctattattcttagtgatttactattttctatagcttagaataatttattatcctaaaagtagatttgatttattactttatttgtagaatacctacttgccttttaatcttagtatgatttactttttatttagttagaatcacttgatcttctaatatctaattaacctaatttaaaaatttattttttatttcttcttgctaaaagataacataatataaaaagaatacaacgataatacataacacttgactaatataaataaatcaattaaattttaaaatctacttaacatgtttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaagaattataattggatctgatcctacaatctcttactagttcgtatgatcaatttatagtaaattatcatataaacaagttggactgcaccctatctgaacttgtcaacatgttggttactattgaggtaattttgaagagttcaaagagctttattcttgctgtggagcaggcaccttcctcggagagaaaattttttgagaagaaaaagaataagtctatgaaaaaatagaagaaggagaagaggctgaagaaggacactctgcagaagactgcagacaaaaaaagtacttccactgtcagaaagacggccattggaagaggaactgttcgctgtacatacctggagagcctgaagaccaagaatgatgataaatcttcagaagatatgctcattattgaatctaacctaataattttctttatgtctagttaggtattagactctaattcaagtgctcacatatgtacttctatacaggatctagtaggcagtagaagattgaggcatggtgaaatgatccttcagatcggtaatggagcaagaattactgctgaagccattgacatctactctcttcgactaccatcaggctttagattagttttaaaagatcgctattatgtatttgtagctaatcaaaatttgattttcatatctgtactagtacaaaaaaaatttatattcaatttcaataaaaattttgttttatttatttgaaaaataaattgatagcatgagatattttaattcacagtctttatcatctacatgtcgatgcgagtgcaaatataaacaagcaattatgagtgctataggaaataaaagatctagtgatgacattaaccataagtatatgtggcaccttaaactttgttatataagagaggataggattaacaaactagaaaaggatagtatccttgactcattcaattttgagtcatatccaatttatgaatcctgtctttaagaaaaaatgaccaagctatgtattgtgggatatggcaaaagggccactgaattacttgctttggtacacaccgacgtgtgtggcccatttgatgtgcaggtcgggggtgattaccactactttattatttttatcgatgattttttataataggaatatgtgtttttgataagacacaagtttgaagcttttaaaaagttcaaagaatttagaagtgaagtagaaaaaaaataaaaaaatctctcaaagtttttcgatcagattgaagaggagaatattttagtaaaacttttttgagttatctcaaagaaaatgatatagtcttataatggactccttctgagatgtctcaaatcaatgggacatctgaaaggaggaacaggatcttattagatatggtccgatccatgatgatcttcactgacttatccttatatctttagggttatgctctactaaccatgatttatttactaaataagattctctctaaatctatttctactatatcatatgagatatattatgatcttaatcatcttaagatttggagatgtccagcctatgtgaaaagacaaatggctgacaagttagaggctaggtccacgaaagcttgcttcataaggtatcctaaagaatcaatatgatactacttttgcttttcagacgatcataatgtaattgtgagtcgacacgctatgtttctagaaaaataatttatccaagatgttggtgatgggaggttgattgagctcgaagagaaagtctttaaaaaataatgagttgttgaactagatgaaccaattaaaacaatggttcttcctccctctcatagatctagttggatctcctgtcctcttgaaaggtacttaggtatgcttacagaggatctagaagaaatattcttcgtaggagataaggatcatggagacactacaagaaaagagagtttttgcgatgaatttattgacgatggaaatatctttcatcatcaataaggatatttacgatgaaaaattaaatttattgctaataataaattatttacgataaaaattatttttcatcataaatagatgcatatttatgatgaaaataaaatttcattgtaattacatattatttatgataaaattaatcatcataaataataaaatatttattttaattttaagttttcaaatatttatgatgaaaatagtttcatcataaataataaaagtatttatgatgaaaagttaatttttcatcgtaaatacttgttatttataataaaaaattttcatcattaatatttaaaaaaaataaaaaattttaaaaaatttaataattaaagattattgacgatgaaattttttacatcataaataatctagtattgatgatgaaaattaaatttttatcataaatacctaattatttatgataaaaatttttcatctctaatatgtgaaaaaaataaaaaattttaaaattttaaaaattataaattatttatgatattacatcacaaataatggagtattgatgataaaaattaaattatttatgataaaaaattttcatcactaatatatgagaaaaaataaaaaattttaaaaatttaaaaattataaattatttttgatgaaaatattacatcataaataatgagtattgatgataataattaaatttttgacataaatactatattatttacgacaaaaaaattttcatcactaatacatgagaaaaataaaaaattttaaaaatttaaaaattataaattatttatgatgaaaatattacatcataaataatgaagtattgacgatgaaaaattaattttcatcataaatactcacagtatttatgataaaaaagtttatcgctaatatgtgaaaaaaaaataaaaaattttaaaaatttaaaaattatagattatttacgataaaactgttacatcataaataataaaatattaatgataaaaactaaatttttatcataaatactgtattatttatgataaaaattttttatcactaatacatgaaaaaaataaaaaataaaaaattataaattatttgtgataaaaatattacgtcgtaaataatggagtattagcgatgaaacatcaattttcattgtcaataatccactattgacgatgataaatttttcatcgctaatatttaaaaaaaaataaaaaattttaaaaatttataaattacaaattattagcgataaaaaacttttttattgaaggatgtttagatatattatagtaaaatttttttatatttataaaaataaatattagataatttttaaaaaataatatgtgcataagaaaagtatgtagaatattaagatcaatatgtagtaatataaaaaaataaaattaaaaaaatatttaaaaaaattatttttttaataaagacttaattgatttcaatttaggatctatttgaatggttggatccaaaatattatgaaaatcaaaaatcaatcctagacaatagtaaaataggccaagcttaacttataattctgtatatttggtagttggctcatgcatctcatagaattttaggcccaactgtctaaacaaacccttaattggattcaaagttgcaagcgacaagcacatgctggtcacttcaaggcctagatgggatcatccaacctacttgcgctcgattatatataatttaaaatattaaaaatctaatcaaaattttaatttaaaaaatccgaaactgatgatctggttccttgtctaattcatggtttcgaagcctagaaaaatacttacattaagcataaacaacaaaacaagcaaccaagctaaacaacactatccctgataaagttttagttaatagtaagcgtggccgattaaagtggagctatgttatagaagacggcagcatcattaccctagaagggcaacaacgtctaagaattaccttctgttgccgacattcttgaacagcaaggctggatgctggaaaaagagttttatatttataattgctttattctatccatctccatcttatctataatgtaaaatttggggatctcaagctgtatgctttaatattattttttgaaacttttaaatatcttcgtatctgtcgaccattagaaccttttaaaatatcataatatttaaaaaaaattaccaaaatttttttaaaaaataagaattttttcaagtaattattagcgatgaaaattttttttcatcgctaataatgtaattaacgataaaaattaaactattagtgatagaaagttttcgtcgttaaaaatttattagtgatgatacctatgtttttgtcacaaataatatttttgggaggaaaaataattttttcagcaatttttttttacgaaaattatgagcgatgaaaaataattatatcgtcaataaaattattggcgatgaaaattttttttttgttgtaaattatttttttatttaaattattagcaacgaaaaattttttattagcgacgcattccgtcaagtcccatttgaaacccattttcttcctcgatgccccccatcgtgctttcgcgccccccccccccggcgtccccctctttgctctgcctcttcttccaaccgtcgagttcgccaccgtcgccatcctcgatcaccgtcgccatcgcagtcgcgtccgctgataaggtaagctttctttatttttttttttgaggggggggggggttctcgggccatcggtgggccgtcggggatggggggagacgtcggtggggatggggccgggccggtagggactgtgttcgctgtcggtaattcatctttattttttttattcttttgtcgggccaccaggctagtgtggacggtgccggggcccgagggggccggcatagacgggtgggccgggtcgggcctggtcgggctggcgtagatggggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggacttctgaacaatttataaagcttgtaagggatgtatgagagccactctatccaaattgtacaaaatttttcaagttaaaatttttgataaaattgcttcatactaaaatcgtgaaccgatggagtcagaagtcatttgatcaaattttaacattgattaaagtagctcttttcgatggagagagactttcgaaatcatattctgaagcaaaaatatatatgcgaaaaattagacttggctatattcttatacatgcctgcaaaaatgactgtatattattttataaagataatgaataagcaactgaatgtccgaaatttgataagccgagatacaaagctgataataggaaagtaaagaagatacctcaaaagattttgagatattttttattgatttcaagacttcaaaggttatatatgtccataaagatagctgaaaaaatgagatgacattatgagtagtgacttcctgaggagaatatacttagccatctggtcgactctttagtatggaaagacttcgatgcaaagcattcatactttgcgagtgatccccacaatatctgacttggtctagcgatagatggatttaatctctttggcaatctgaataccttttataatatgtggcctgtgatactagttgtatataatgtgtcaccttgaaagtgcatgaaagaaccatttatttttatgtcacagttgattccggatccgaaagcaccaggtaatgaaattgatgtatatatacaacctttaatcgatgatctaaagaagctatgagaaaatggggtacaatcatatgattctgtgagtcaaaataattttaaattgcatgcttcgattctatggaccataaataatttttctgcatatggaaacttatctggatggagcaccaaaggatatcttgcatgtccaatatgcaatagggatgcatcctctttatatttaaagcacagacagaaaatatatttcataggtcatcggtagtttcttcctgctaatcattcttggaggatccgttataaccaatattttgatggtaagtccgaccgatgttcgccacctaaggagttaaatggagcaaaaattttagaacaatttgaagtcattgaaaatgtctaatttgaaaaaacatcgggtactcgcaagtggaagcatactgaagctgagctgaattggacaaagtgaagcatctttttcgaactaccgtattcgaagcagctactacttcgtcataatctcgatgtaatacacattgaaaaaaatatttatgataatatcatcggtactgtattgaacatctagaaaaaataaaagatggtacaaaagctcatcttgatttgcaggaaatgagaatccgatcgaagttgcatttagttcatcgaggtgagagatttttttataccacctacatattattcactgtttggtgaggaaaagaaaaatttctgtggatggtttaaaatcgtaaagtttcctgatgcatatacttcaaacgtatcgcagtgtgttgggaactacgacggtaatatctctggcatgaaaagtcatgactcccttgtgatgatgcaatgtttgcttcctgtggtcatacgtggctatttaggtggtgatgttcaaactgcattgattgagctgggagtgttcttccgagaactgtgttgtcaaaaattaaagattaacttacttgaaaaattagagaaggatatcgtactcattctttgtaagttagaaaaaaatatttctaccatcattttttgatgttatggtgtatctggctgtttatcttccaaagaaagcacttttggtcggaccggtacattatcgttggatgtatcctattgaaaggtaaaaaaattatacgtactttatcatatcaattataagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttactaatttgattagtaattttacagagatgatgtgccaaaaatacggagaatcggacgagacagaccgtgccgcattgtgggggttcgagatcgttcgctcgtcacatggagtacatggtaggtaatttttaatttttaattagcatataatttttagttatttaaaatttttttaattaattctcaaattgcatagagatgctgagagtggcgagcttcctgataggaacgatatttatcagcgaacccactagcaatgattgggggagtggacgatggggagccaagagctctttgtatattttttcaattattttttcattcacagtctgatttttattaaaaaattaaaataattttaatttttaagatcgtaagacagacatgagatctcagtctatttctgagggctcgatcgcacccacagatgatgtgatctgtgatcaggtgctcgatatgagatcctgttatgttagggatctagggtatgggatcactgctccctcatcctcatgctcatctagggctgacatccattctgcgtgcgagtttcgactgacggacgtgcagaggtagattgccgaggatcgacagcaaactgtcatagatcgacagcaggttgagtaccgagctcaggagttggctgcacgcgtcgataaatatcagcagcttcagatccagatgatagagtggatagtacagatagagcagacgatacaattgatgaggcagcagcatgtaggttcgagctccgtcaagtgctctccgtctccagctcgttctctagatgtcgatatttgacgacttattgatatattttttattttaaattttttataattttaatttaatataataaaataataaaatttatttatcaatttattatgtaaattttttatttttatttttttaatttataaaaaatattatacatataaattaaaaatatatattcaaaaaaaattttaaaaaatatgtctaaattattagtgataaaattattcatgatgaaagattcatcgtcaaatatattttactaacatgatttaattttttaataaatatataattaacagtaacaaaaaatctttcgtcataaataattattagcgatgtaaatgtttgtcgcaaattgaatcatttacgatgtaatttttcatcgctaatattatttaattttattttctaattttttttattaaattaatagtgataaaaattttttattataaaaaataatttttacgatataaacttttagtcgctaaaactttagaattaatggcgatgaaaatattttcatcgctattaattttttatttattagtgatggtataattcatcataaatatctttttttatgattaaatttttttatttttaatgatgaaaaatattcatcataaatattttttattagtgatgaaatttttttcatcataaaatattatcaacgatgcgattattggtgacgaaatattagtgacgaaaattatgtcgctaatatatattagcgataaaaatcgattattagcgatgaaaatttttcatcgctaataacctattttgttgtaatgagataatcctaaaatctataatgaggcgatgtcagacatcgactccgagaaatggttgaatgctataaagtcagagattgactcaatatatttgaaccaagtatggaccttagtggatccaccagaggatataatatacattgaatgtaaatggatctacaaaaaaaaataggtatagatggtaaagtagagacctataaagctaggctcgaggtgaaatgttataatcagtgcgaaagtgttgactatcaggatatcttttcgcctgtggtcatacttaaatctattcgcacactgcttacaattgcaatcttttatgtttatgaaatctagtagatggacgtgaaaacgatatttctgaatggatatcttgaagaagatttctatatggaatagcctaagaatttcacatctagtgatggagatcataaagtctgcaagctgtaaagatttatatatagattaaaacaagcttctcaaagttagaatattcatttcaacgatgcaatcaaaatgtttgatttcatcaagaacgaggaggagccttatatttataagaagatcagtgggagtgctgtcacattcttcgtactgtacgtggatgacatcctccttattgggaattacatttttgatcaaaagatgattgtccaaaaaattttttatgaaagatttaggggaagcatcctatattctacgaataaaagtctatagggatagatccaaaaggatgcttggtttttcatagaaaatgtacataggggaagtgctaaagaggttcagtatggagaactctaaaaaaagacttctatctcctaggcatgacattactgtctccaaaaagatgtgtccaagcatatgtgagaaaattaagtgcatgtttaagatttcttatgcttcaggtataagaagcctcatgtatgtcatgttatgtagtcgacctgatactacccttactgtgagtgtcatgagcagttattagtcgaatctggacgaagagtactggatagctgtgaagaacatccttaagtacttgaaaaaaattaaaaatttattctttaatctttgacggaggatcagagctgtggttcgaaggatatattaattcagattttatgtctgattttgatgatagaagatctatatcaaattgtgtgtttgtatgcaatggtgaagctaccaggtggaagagttccaaaaagcccatcattacagattcgataatggaagctgagtatgtcgctgcgttggatgctgcaaaggaagctttctggtataaaaaattcatcgcagaacttagtgtaatgatattggatgccattactttatactacgacaacaatgacaccatagcactcactaaagagtctagatcttattagaagtccaagcatatcgagtggcggtatcatatcatatgcgattatctcgagaagaagtacatcgaggtgtaaagagtagactctatggataatgtggcagatccattgataaagcaattgagccagtagaagactaaagtccaccttgagaagatggaacttaggttagtctctaattgactttaagataagtgagagattgttagatgtatatcctgaaaagtgaatatggtaggatatattgtaatagttctatgatatatatatgtacttaaacatcgaattatcaataaaggataatttttcttttctattcttgtttaatatatccaagaatcgtcttaagaattaataattcaaagatacatattctcaagagttgagatttagagatatatatgattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtttgattctcctgtttttttttttccgttttggtgggctgagattgggcttgggcttgggctaggttttgggttatgacaatatctcactaccagacagaatagaacctatggagtcatatacaaaaggagtttgattagatcaaatggttagattatgatcaaattatcaatatgattgataatttagatcaacttgtaaaagttacaagcattggatcagctaattgttagctaggaggacctaattgcaaatgttgcaattcaatttgatgagatcaaattagaaaaccaagttctaattaattaaatcaagcctaattagtttgggcttgacctaattgagtctaattgggcttttgatttcaaggttaaatgctaattagattaggattaagtcgggatcaaattggactcaaatcgatttcgaattggattcgaattggatcgagattgaacacaaaccacagagccccaatggactggacctctcttccttcctctacaccataataggggcgtcaattcaaattgacatccactccatgtgcgataagaaggtgaggaagagagggggcgcaaattcaaattggcgcccccttgttgatgagctttatcccttgttgattagttctatcttctctttgatcgggatcagattaggtttgttttaatcttaaaactcttatcagataaaagtccaagatcatccaaactctatcctagcccccttggccgccaattataaagggacatgggtcttgggtgtggagtaggattaagatcattcctagatctaagtactgccgccccatctcgtcgcttccaccctaatccacgcaccccacctccatctagtcggccaccctagagaaggaaagagagagatcagtgagaaagagaaaggaagaaagggggaaggagttctcctgttgtcttccggattctccgattctatgcgaaaggtgttcgcgtgttgatccgcgagtcttcttctacgatagttgaagaagaaatttagatctgaacctgaaggaggagatctgcaagaaagctagcatctcggtggtctcggacacttcgatctacttcagccttgtgtggatacgtgtagaggtcggatgtatgtgcggtttcaacggaacctacggacattcttagatccgatctgaagaagaagttttgtgctacagataggtgatctgatcatcagtttaatttttgattattttattttgaaatcagatgcatgttttcatcttgtttttcatcatatgaactagatctataggtgtcagattagatttatgcatgcgtagattaaaaattattttaatctattttttcgctgtatgttttaaaatagttttgaaaattctacatgtatgacacctcgaaatccaacaatacggaggtttgactctaaacttataatatggaaaagcaaatttatctcatttggcggaagtctcactcttgttaatgctgtgctttcttctcttccggtctgcttcatgtccctatataaattttcgtcctgggtcatcaagaaattggatagaattagaagagccttcctttggaaaggctcagactcagcaaatggcaccaattgtaaagtcttctggactaaagtttggcttcccaaagaggaaggtgggctcggaataagggatttgaggaccttcaatcaatcacttctagctaaatggggttggagattcctaaaggatgatccaggatggtggaaaaaaattgtagctggtgtgtatatcaagaggatcaaattatttgaaagctggagacctaatagactatgttctaatatctggagggatgttatcaattctataccacatatttggaacaaaactaaatatacggttggtagtggcttaaatgtttcattttggcgtgattgctggattggtttcaccccactgaaaattctttttccaaatatattcaatagttgccgtggtaaaaatggtatggtggcatccttcctcaattctaatcggggaagatggttatttagactcacatcccaatctccattagtgcagcacgaaaaagcgggtcttctctccattctctcagatgtccacttgaatgttgatcaggataagatcacttggtagctggaagcctcggctaatttctcctcttcttccttgtacaggttcctcatatctagacatttgaggtggtctctggctaaaaaaatctagaagagtaaactccttcaaaagtcaaatgtcttatgtggcttactctattgaaaaagattaatgccaaggatcttctccaaaagaagcttcatagaaactttggtggttgtgttctctgttttggagcctgtgaatctatggaccatttatttgtaagctgtccttttagctctcagatctggttttggatatgtgacagcttaaaagtccctgttgtgcgtgataatctaacctaaatatgttcttcttggtgcaaacataacttcaaccgtgatcttcgacaatctatgctcatggtcgtggctgcgttgatttgatgttgccgggaagaaaggaatgcgagaatctttttaaacaaaacttcctcagaagagagggtgttttggaaattgcttcacctaatcagtaattggatggcactttgcaatcaaaaggagttattaggcctttcataaattgctgactacctcttcatcagatcagcctgatctcagctatgattttgagtttactgagtgtattttctgatatcaaatcttttgttttgcttaccacatctatcttctcttgttctctttataacctttggtaaccaccctgatgttttctgttccaactgaagcttatctgtatcctactcttgtgtagctctttattaataaagattgggtggcctatagcctcccacgttctcacaaaaaaaaagagaggatgcaagcaagcagttttgcttgcctgtgagtgcaatggtgttaacagttaaatcagccattgtacttgaggattcaaattaagatatgattaaccatagctcaggtggcttttttttttttggggacaaaaccatagctcagtcgttgtcattcagttattaatttttcttccccttcacctatctcgtgttcttctgatcaagcctaactatgagtatctccaggaatcagtattgttagtggaaataaagaatcttcagacatacataagaactgagctaaatgagaatgtatgatgacttcacaaggaagaaggttgtctttgcatttgtagttgtgttagtatttttgtagttttcttcctagaagggaatcatgagcattctattgataaatttttggaagcacgaataattgctggagtagggacaaggaggccgattgttctgatgtggagatgctgaaagcaactcatttcgccggtagctgagaggtttccaaggcctcagctaatcttccctgagagttcccaacctgacagaattgtgtagcctgtgcacattgccagcattgaggaattttttttttttgctttcttcttctttttttgaaaatttataatggaaaccggcattgcaaagttgaaggcaatggaatagcagcagcttgagagccaactaacaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataaaaataaaaattttaaaaaatcttaaatttttaaaataattaaatttttaaacaataacttttttgaaaaatgtcagataattagtcaacacaacggttataacggccgttatttgaaacctctctcctcgatcggtaatttccggcgcccctctcgtccccttccacgctgcaacatccgccgccgacgctcgcttgccggagatctcccatccctaccaggttctctctcaagacctgagatggcaacccaagatctctggcgtcgcaccactcgaatctgatcctcgtcgcccaattctctcccccacccctcgtgaccaatctagggctccgccgtgatccagagttagggcttctctcccttcttttcgtgatctcggcggtacccatccacatctctttgccctaatatacgacttctcgataattccgacgagagaagagcgaaaatgcgattgttccctttcttcctgaataaaaatgcgtgctttttaggacaattggctcctgttattagatgattttgcggtaaatcttgctgtgaactgttatcttacattctggagatcaactcgactcaactaagtcttaattccataccagttgggtcggcaacgtctcactatgtttctaaaacaccgcaagccagcttctttactgtaataacctaacaaataggaagcagggatttcgaaagggatttctttcatcttcataattgtttcatgggttattgctgaagctgttggttggaattacacggacaatgtagattgtccaagcagttcagaatttgatggaagctattttctttactgttttagcgatataaaatcactgcttaagcaacagagtgtagtcattttcttcattgcatatgtttctaatttatacaatcgatatcggtggcaaggagagagtatgaatatagcatttgaaggctcaaatatcggaaaaacctttagccttggaataactatctagatcactaagtcatgaatccttatatatccatattgtacaattagtttttagttgttctgaacttctctatgtatctgacaaaatccttgcttgtttttgagtctatgttcttacttgagttgaattagcgagaatttatcttgggaaaagaattgtttactatgcaggctatgggatcttttttctcattggcattcatttctcttccagccctgagtgcaagaagaccttcttaatttaaatgcctttatgttgatttattttaatattgttaattttttgtagtgatcctaataattccatggccaggcctttagaagtgttgcggccaatctcctcgtcgcctggtcgccggaaacgagcgtctgcaaaagaagtccacactgaccggaggtgactccggcggggatcctccgaaggtcgtcagagaggagactaggcaatagtagaaaagaatcaaggaactcagcgagagggagagagagagggtaagcccaagggtttcgaaagaacctcctctagcactgttgccttccctgttttataatagagcgcggcatggcaccgtcattaatggcgcagacaatgggagagttgtcaaatcgccggaggttgtcagagtcgttgtggggctgtcaaatcaccgtggggctgtcaaatcactagggttaacccatgtcttgggtgggacaatgtctcagggcggctgcgctgcatgcctttgtcagggcggcggccctcagcagccgtacggtgttcggaggagccgatcgaccatacgtcggcatttggtcgtaggatgtcgggtgaagacctagggacaccgtcggctggaacggcgcatcgtggggatcggacatcggccaccacccccgatggccaatcagatgtgttgccaaaatcgggggtcgggccgcgctattcggccagtcgggttcgggaagggtcttctcgaccgatatacctttggtcggacggtgtcggttggtgcggtcggtagagtcgggcgccggccagacgggcccaacggtgagtcggcgtgagagggaccggtcggtatatcccaacaagaaggttggcagtttcagtggataaactgtccaaagtagtagcagaagaagtacctggaaccttgtcttcattgaagatgtctggcttggagattaatgatttaatttgccaatttaacaatctaatgtaagcttctctgctcagtgtttcttgtccaaagtagtatcagaagaagtacctggatccttgtcttcattaaagatgtctggcttgcagattaacgatttaacttgccaatttaacaatctaaggtaagcttctccagtcagtgtttcctgtaattacttcaaagttcaaaatgtatatctactcaatccagataacttttccctttcttcattatgttttgaaggcaaagaatatcaggaaaccaacatggaaagaaagttagaacaaataaatcgagcttgtgggggaagaagtaatccaataataaactgatctccctcctagattcaagtgtattggagtttgcaaatactctaggtctaaagctgaaattgtgatcaggacacagagtcagtatacatttcaatctgatttcacagattccatgaacacattttgtgttctggaatatggattaatatcagtcaggtttcatctgtagattaaatgactggaatactgatatgttttctttttttttgggtacaagaatactgatatgttctctgggcccctttttttctaaaaacaggaagaagatagttcaacctgttatattttggaaatatacttaaaatatctggcaaatttgtgacacattgtggtataccatgtttctatattatttaatttcatttcaatactggcaggaagagaagaagactgttagttgtctttgatgggaagtgtggtaacatgtaaagggtttcgttggctttgaaacatatcagaggtacagaagtttgcaaatgcagtgtcagaaattgtttacaacttgaaaataaggaaatcaactatgagaaatccattcttgaggcggctatggtaaaactatgcttttcgattgattcaatttaagatttttttgacataagcatgtgacaacaccatagcatagctgacttggttcaaacctgatcatgaattgcaccagacaaatactggtcttcttatacttgaatctgacagtgacatcaatgggcttttgtgatatagcatcatgagaaaattaatccagcaattgataactttcatttgcttactattatttcttggacaactcttagtgatattgccagaagaatgtggttaagtaaaaccacatatttggtatagactcttgaagttgagcttggttcatgtttcatctacgtttatattaatggaattgtttagtttgctttcattcaaggctttgtctctgctatttgtcttaggaaaattatgtgctaaaagttaacattgttttattcatggaacctttagaatttttcttcctagttcttttcttttgatagcatattctctttaccttgaccatgatatggaaaaaaaaacaacatgagtaatatttgggaattaaagtgtgtccgagcaagcaaaagttggattgaatttcaaattcttgtagaaagtagtaacattagagctagtccataatgggaaggctcaacgaataaggattgatagaactaacccctaatatttaggaccaaggttttaaaacctttttcagtttcagtcatttgggtagtgtttcaatttcagccgtttcaacggttttaatagttatcttcaagtttttgagtttcgggaaaacagccgataaaatttacaaaataagagaaaaataaaataaattaatacaaatttgtggcttttggaggactaaagaggacaggaatccacggtttttgtgagattcttttgatgcaataaatgtgatgaggaaaaggaagaaaggtgaggcattggaactctatttcagaagtaaatgaatatatagagttgaaccatgcagtggagtcaaaatgggaaattttaagttataatagtaagatgtttgtaacaagtgctgatctgtcatagtttggagaacattcatgatgcaagtatatgtttcatagcttggcatacttctttacagtctcttcatagctcttcatgttctctgatgcttgttgattacatattagagtaaccctagatgttgacagaagtgcttttctccctgtggttgaaggatcactctttcggatctgcacctcccatacctatccaaaattaattgtcatgttaacatagcatcatttaacatagactaatcaacagaaataaaagtttaggattgtcttgataaaaatcaggctgatttgataattttcttcttgcaaacaatcaaagttttaaatgccatggaatgggatgcttcgtgtattgatacttgagatggtggatatcccatcccatcctaagaccttttcccaactcattctgtcccgacatttgggatggtgcaccatatagacagttggtatttaaatccttgcgaacaatcaaaatatgatttctttttttatgttttacatcttgtggtgattgaagcaaaactcataatgaaactaataacatgacactcaaagagctgcgattcaataactgtagatctcttcactcatcaaactgttgaaaacaatcttgtatgttcaaaaacaatatctttcttgttaatgaccttctagtcgagcaagttggaaataccatgttcttctgtggtataacattttcttgtagcaacgccatctacttaagaagaactaagatgcgtagaatgtgggtggaagacatgagcaagattaaatcagaaattgtctggccatttttttactataagaatataagccggcaactttttgagtaaggtgctcatgtcgagaataaggtgctgcatctcgcacatgagtttgcagatgatattctcattttgctggaaatgacatcaactatatgtagacacttcccttcaccattatgagatggtcttgtagctgaaggccaacttcataacagctttgtgatgaggtgaaaaatttagtggagacaacattaaggtgttgcttaagttgtttggtgcactgctctttaaatatttagatctccgttttggtgttgacccaaggttttctgtaaacaagagcaggaggtaaaaactattgtaaactatgtatattgagaatgagatggtgctctctatcataaacaatgtggtgctctctatcgtaaacaatgtatgccgagaatgagttggtgcttcttgggctgcagactgagatgataagagcaacccactttaagtcaccaaatttcttgtttcttttctaatctggcaatgaaaatcctagataacatagtaaatatgcaattaaacatcttttgggaagtggttagtgggaattccaaggtttgcatgagatttaacactagctaggtatggtggaccttgtccttggcaatttgaaagctagtaatctgagtcttttctttacaaatgttgtttacatactggagatgtagcaccatcttctatgtcaacaacaaatgttacgaaggaatcgagaagataatgttaaagaaggtgaaagcttttgcagttggtggagagggttttaatggaggttgaggattttaattggtaaggtgaaaaagttaaattatgagatgagcttgggcaggttatctgattctagaaagtatttccttatgaagagtcaccagatcttctgatatccttgtgattgaggcaaaagaagactcaggcaagaagtggattggactactttcttcaagaagagaccatctgaggtggctattagctagattttgagaactgttcaaatcaccttgtctgacctacttaatgacatagtcattagatgatttctatatgagtcccatccttcaaattctcttcaaagatttttctgtgatatttaaagtattacaagacatctttaacataacccttgaatctttccttctttgcttggagtagatgctctcgcttaaaagttggttcctttttttttttggatgagagaatgaaattccattcaattatgtatcaaatgacataaaatttataattcttgctggcttactgtggtaaagagaatgcctgcactgactaatctgacaaaagtgcccaagagtgatctctctctacatgctatctgttgagaatacaatgagtcagctaattttcttgcgcactgtgaagcaaaagtgttttcttatgacatgagtaaataggaaaaggagtcccttcatggaattgatggatattgttttggttgtcttaatacttctgtggttcgtttgttatgtagatttgtcatgatgggcatttaatttttaaaaacttatgagaaaagaagtgttctaacttataagagagtgagagggagaggtgtttcatttcaaacaaaggcctgttggcagagaactttgttgagagacgataacaatgtcatgtactctttcatgcacacctaaaataagccagatttgtcaatgttttcggaatgcaaaatgatttgcaaaccaagatgtaaatcgccatctttatacttcattattctgattatatttccttggaaatagtgcttcaagatcaggtgtgtgatctgcctagcattcttctgtcgttcatgctacatgaggatgagttaaatttctttgcctggaaggcatttgattcacaagattgtaataatatggagattacactcatgatgacagaaactaaaggtgttgattttctggttgataacgtcaccaatggatgattcatgattccaaattctcaacacatgaaactacaaaaaaaaaggaagtacaagtttgaattctgcgagaaaagaagaaaatcctgagctattatctaaaatttaggatgataatcaccatcaatcccaacattaggacaagaaaagattttaggaattaagaggagggtcaagcacagttgagataatgtgaatccagatgaacaatggtctcttagtgtgcctttactctttcattttcctcttgctggctctagatagacatctcatgacatttttgtagaacaaacacataatgatggtatgttgtgcatggttgttgggtttgggttgcgttggtaaaagggaagaccgggtagagcatctcatgtcttgagggttccatggcaacctcccataatgccatgagttcctctgctgcagtgaggtgggttgggggttctggtgatgataggtataatttccgagcaacctgggtgcattgttttagtttgaatgatggattcgcaggtggcctgctctgcatccaatttgggagtcagattctaccttcaattgtgatgatcttgtccttctccaaaataaaaagaaattaaaattgcaaatatgactgttaactgtcttttttctaaaaaaaaaaaaaaaaaaaaaaattcttgccagacttttgatttactaaccctgaagttggactatggggtaggaattttcttccaagacatggctagatttgttttcctacttcatgctggctaaagtggtttctggccgacctatttgtcttggttccttcctatccctgggtcagaattaagcagccggctttctggaattcaaaggcaggtgttgtttaggtggtgtctctatcttgtttttttttattatgagagaagtctgtcttcttcaatccagctataggggctaatgttttccaggcaatcaacgtgccttgcccgccattgccattaccagtgccagctctcaaaaatcgatcctatccagaggccacctcatggatgacttcatgatccctcgatcacagaattatcctctcatgtgacttttgaatcagagaaaggtaagacaaggaggactattttttttttcctttctttctttctgatagaagacaaggactacttggactattggatttgaactcaattgccttcattcaaagcagagcttgtttgtttacctggatggttttgcccgcctggatgggactggcttctgcctctatttcttcgccgagcagagctggcttgagatggttggtggagagctgaaccccggcgactctccggaatccagaggccatgtaggctcccaagctggccaaggtttccgagatgagggccgacactcctccgttcagcacatcaaaaggctgacacgatcgatccacaaactcacttaggatacttcaattatgtatagaatgaaaccagagatagattattattatttttcatatgaacacaaccatcaagagctagcggcacagacagataggttccaaaggcaaaaagtagcggggaaagcaagacgtccaaaagctgagaggacggattatccagaagaattgtacctggcagcatgttttggtgaccttgagccttcccgtaaccttttttggcgagacgagctcgtacacgaaaccgatagcatggagagttcggtcgatggacgctgtcatcgtcgctggagacggagatgatgttccttcggggtctggattttgagccatcttctttgatggaagatgacatgctacatggcttctgtcggtgttcctttgttgatatggtttgggcttcaaagcagagctagcccccagctacctcttctcttctagctaccgcacacaaaaaattaaaataaaacaaccatgcccaagggcctacctaaaccattaaaaaagccagctaacgcatgcccacatggttgctggtgtgaagtccactggctgaccacgtctttccaacgtggtaactattggtgtcaccatgtgatgaatattgtgaggaaagaagcttggaattggattcgcgttcggatttcctgatttacggttacagctcaaacccaaccaaattgcttgacagccgttgggggagtctcggagagttgaatggaataatggtatgtggtgggggtgggaaggccaccttggctgttctcgatcaattttctacgcccttctctggagaaagaatctgtttctctttcccttgtctcttctttagatagtcggagattcttttcctgtctctttccttcggtgtttttctttttttnttttttttggagggaacctttaggtttggtatacctgcctccaaatgtaggcttagatggattaagtttgaaggcacttctacagtgggagtgcgaggacacaaattactgctctccctcgagcaagaagcccaaattcagagctaagcaaagagtataatattgaagttgtaacatcgacttcatccggtccccaataaagcttgggtcccagtgatgcactcggatggcaattctgacataccagcaaggttagacatcaagtgggagactgattggccaagggcccatgaccggatgcagatatcaacgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttattttttttgcatagaatggatcatagccggaggaagatgctcatatttttgtgctcaactcctgacactgcagttcttagggataaggttggcagtcattgataccggttttgttattgggaggaaaatcggaaggagctaaggaagttgcaccatagctcgactaagactgtggaccacctgttttcagattgcttgttcttctctgcagtctagacagcaatttgcttcaagcttggggtgctataatcttatggatcttttgcagggcttcatttgaatcggataagatggaattttccaaaaatgggtaggctggtggtactaatgctcgttggatgttggaaagagaaaaaaagtagctaggcttaagtggcatttgaagcactacatctcttcaatctttagtccaacttatgcggtgggagctcaccagtggaacataaaaaaatttggcataaaattaaaataattcctgcatcaccctaagacccctgacccgctacccatttcctcttgtatgtaggccgtagagtcattaacctttagtcagattttgagagtagttttctttctaaaaattttgtatttggcttgtaattgctactgtaattctgaaaattacttgacagtgctataatttttgagtcggacctgcaacctcttttgatctataattttctctgtttttattttatgtatattctctgttattaataaaaactggatagcttccagcctcccatactcatcaaaaatattttccaccacctacgatgcgcctttcttaccagagacgcctatgatctatatgttgaagtccacgtatttggctataggaaagttcaatccgaagcaaagccaattattatgggagtgaaatttggatttcgcatgatttgctcttgagttcaacaagtgagattttacacaatcatgctggattgcaatgcactgccaacttttattagtcgacataagtgctgttcttgtttatagtttaggagcacggcgattaaggtacaaagtagtagaaggtagatttttttttaaatttaaatttattttattttattttttgtgtgcgtgtatgtgcagggaacaagttagattaaagttgataatcttttcatatgggaatctcgttcttgtaactttatcatggatgatttgttgaaaagattttgggtacttatatggaggtaagaaactcaaataatacctttcaactgattttttttagataaatttctgtattgttataaattttattagggctaatctagtctatgatccatgtggactattccacatattgatcataatatttatgaatggatctatataaatttgaaattttaaacacgaaaatatatgagaacacatgcgagcatgtattttatctcatattagttatttacttaaaaaatttaggattgttattcaagatcaaaaaatctgaataatatcttctgattagtttttttgaacgtggtattcaaataatattttctgattaatttttttgaatgaaattttggactatagatacccacaaaggttttttttgatgattttttttaattattaaaaagaaaaaaatatttttctatgcgtgtacgcttgctccttccaaccgcaaacaattgggatgtgaattcatcgtgcactaacttttgaccatcatatctcttccacggttaggctgagatgcacttcgatgactgaagtataattttacagatagcaagcagaccacacctaacactggaggaatatgtggctcctgttacctaaagaaaggactatgtacgttatgagttttgcttttaacgttttgttgagcagtaggactgcacttagggaactttaacataatcttttacgcactttcacaaagataatgtacattaatgctaaaaaatacgacaaagaccaaagagagaggttgcttgccctgtcttcctattcaaagtgcataccaaactatggcttgaactagtaatcattgctaggcaagaagggacttgcattcttcgccgggggtaaaggaagaaccttttgaagatccctgcttctaaccaattagagatcaactcacccgacaaggaaaagaagccacacaatcttttccgattacttctattctgtgcagaattttcttccttccaaggaaaacaccagtctaagagagaatagtttgccttaccaaaagactaattttttaatgaagaaagttaatattttatgttttatctaatgattatttcatgcatgatctttataacaatccaggacatcacttaaaaaaacaagccagaagatattatttcgatttattggctctatataagcatctaaaattttctagtacatggccaatataaaactaaacatacgtccgcaggattcttcacatcctcatctcgtttaggtcctgacgttcacatcaagctaaggatccaaatttattcaaatcaactaaaagtatcataaattccatgacaaatatcacgattaggttgtggtcatcccaaattagcccgtgttatagtatccctagtccatatatgctatatgttaaatcctctctgatatcatttcaaacaacctaagatctcattgaaaaagattggttgaaaagtattatttggattcctgatccttgtataagcatctgaaatttatccagtgcatcgttagtagctgatatggagctaaatatattcatgtatgggtcttctgttggctatgtgctagcatgcactcagtaggatccaagaggggttaccaaccaggaggtggctaatgacgtggcaacatcgttggggggttaatttgtccctcatagataggaattaaatgggattgattgcccagtctatcgcttgaggttgatctgatttgatacagatcgactcaagtgcgaagccccttgagcctgtccgcaacacatatagatgtaaggtttcattcctatggataaaggctaataaatgttgccttctatttgacaattaccttttagaagagtggccggggctgcggtcctaacatcttcatagtcctcctaggaatgaagaaaagtttgttacatggacatgtaaaatgtattgatgtattgcaagattgattgccaatgtggacaatttgctgtgctttagcggcatcttggttcattgatccaagtgaccctccctcttagtctttgtcttgttcaaatgatacaaagcaagctccatactgtgtcagtaaatgagaagatctattggtaaaagcatctgcagttttagtaaaacctcacattgtaggaggaaaaaacaaagaaatatgcataacaaaagggattcacaaattgtattgaagattaattaatgtggaaaattgtattgcagatttatttatgtggggatatagaaaagcttgaagaacctatttgaaccagattctgattagctcaattgtgttatctgaccacgaagctttagaactctagaacttttgaacaagacccaagagtgcgcctacatgagagcaaccgcaaatacacgcagcccaaagtttttccttcaccagagttaaacattaaaggccacataaataggctgattgctgactttaagaatcatccaaattttgggttgtatatgcttcaccatacctatctaaaagaccagatggaagtcaatgtcgtcaatgggactaatatcgtagtcatgaaatgtacgtgagaagaccagaccaaccatgctggtcagagtcaaaaaaatgggatgcactagttaaccggacacctttaatggccttacgtgtgtctccatggtcagtcatctaatttggagcgtgaatcccctgcagtgcatcgtgttcaccattctctctgcgatggatggacggccagcaaacaatatatggcatatattgtttgttggctgtccattgtacgatggacggccagtatgatgcaccgtcagaggagtctctaatttttcaccctttggaatgttggcgtaccaatggtctgaaatatttcagctttccttccctcgttcttagaccaaggggcgtgcagattctctaatttttcaccctctggaatcttcgcgtacggtatgatgcaccgtcagaggagtctctaatttttcaccctttggaatgttggtgaaatattcccttgttcttagaccaaggggagggcttctgctataaatgctgggttacttcttgaccctcttacgagcaaatagatgtccttgtgtggtcttaaaggctgagtagtgttagaaagagagagagtagcaaggaagcgagagatgggaagagggaagaaatgtttgctcggctttcttggcttcaagaagaagagctatcggagacaagatgttgaagatggagcgaggcatccaagaaaggttcgaccgagcgacgaggaccagaaccattgctggtatgctgatccaaatatagacaggaaggctaaagagttcatcgacaaagttcatcgcagcatggaccctgacgcatagtccattttcccatcgccagtagctcttccccgcattgttggtccacctatgccatgttttcattatgtaactcagtccaccactgcttatatatgctgctatgtcgttttataccatgaatgggtgttttcttgctggctattaattatcatgtttcgaagattatgcctaaatatatttttgccatatatggatctataatatataagtctattgagtgctatagaccatgtaagtgcaggtatttgataacgcgacatgatctctgtaattttccatgccatgtcttaaaagtctctgtacgtaggatgcttatgaaatttttttttttcttttgggtaagaatgtttatggttgttaggcttgtgcctttggctctttacgttgctcatagaactttgtattaatgcggtattgttctgtcacccatgaatgaaatcataaacagatggtaagaaaaggctggtgatgggagaaacttctgaaatggaatattgagcatcaatagaagagggtgcagctgaaaaataggaagtggtcatgacagtaatgacgaagttcatagtgatttaattgagcaaactagattgaaattgttacaacgacttgcagcactgtttcttctgtgagaggattgtaaagatgcctcaggacttacagatgccagcttcaacgttcaacaccgttctctctcttttctagttcaatttctttgtgctcttgtcaatttctcagactcttttgcttccactgaaggataagaggaaagaaaaaactcaagaaaataatgcggttgcttgatataatattccaataatataaaaaaaagatcctgaaagggaagcactcgaacccaggctgttggatttgtcagcctaactctaccatcgcactccaccaccacagccactaaatttttcagcttgcttttgggttgcaggcttctcattcggtcaatcccgtttaacatttttttaatggctaatcaactatcattaccttaacttagaggttaactgcccttgataggtgacgagaagccacaaggaaggatttaaggagtctaatatgacacaagggatgagacttgcttgatcatttttttcccccttctcccgcttgatcatccttcttttctcctgtgtgacatattgactttgcatcagcttttggattccttttcttgatctctttaccctgcaattctttggcccactcccatcgcatgttacctacaacacagaagggcagaggacatgttagtacgaaaagaaggctgtctttttctagcccatattccttccgtagattacttggagtgcactcacaaaccgccatcattaccataccaaactttttcaccccagaaaaattttttatacaccgcatctaataaaaaaaaaatacattcactccatgtcataatttttcttctacgaatcataaagaaaaaaaaatatttttctcattaaaaatttataaaatttttaaataaaaaaatatctcttctttttttctgacatcctatgaaaaaattatgatattttatacagaaaattataatttgagcgtaggatgtcataatatgatcataaaatatcataattttttcagaagaagaagaatatttttatcattcaaaattttaaatgaaaaaataaaattgacgacattaaatacatatcgaaaaacagtaactatatgacccaatcagatagagtggtatatttttcctacaccacatgcgttgtacaaagaatctctttcaccccaatatctaattaaatccctagtgggtctggcagactggaagtgattgctaggggagcgttatcttaaataaaaataaaagaaaaatatgtcttgaaggaggttagccacctttgaagtgataactaggggagccccttggtcacaaagtgattgatcttttctctaatctctaactatatattttcttatatttagttttctaagatatgaaaggagtcatttcattgtgccaatggcttagggcagacctgggcataaaatttcctagccgtgatagagggagaactctagcttggccttactaaacctctcttttttcttaattacttcatcattttctcaaaaacttagataataagtattgcttcatttccaccacctgatcatggtcaaaaaccagaaaatcttcaaaaaatttgaagttttcactcaacaagtctcccatctgttgaattcacaattaatttttcttctaaaatcaactggtatatatagtgcattctactatacaaaattatgattgttcatctaatgcattctgatacactctaagatgaatcttctatcgcggcattggtgatctagtggcagtttgatgcatgtctttgatagacgatgattgagcgatcacccaacctctactgcttaattttttataatcgtactagaggagtttcaaagccttctgtctgcaagacgacaagtgatttgcctgctcactgctccacttcttctgttaccaagtgagatccatgatctcaacaaccttagacatacgagccattatttcctgatatagttggagcacgtctccatgattactgctctctagtggacggcgcatgttcctgaagacgatagatacccgttcttgtctataaaactctactcttcgagaccctctaggtaagtgaacacttgctccgcatgcttggtcctagagacgaactccattcgaactagaatctgactcttccacagaactctgagttcttttcacttcgccttagatttctatactccatacagtatcctccatcttccattcttcacactcttatacagatcctccatatttcacactcgatatcatttttaagcaccatttaaaactcaaacttgttttatttgcttctgcgaaagactgacttagacatcagaaggtccaccgatgaagaatcatctaatgtgaggattttttttatttttgatgattttacaggatttagttcaaatgacagattgaggacccagcacaagcatccgacttggaagatgccaattgccgtcctgctgcggccgccactctctttggctccagctcagtcgcctgagctaggtgactcccgatggcaacacatcctttgtcgcgggcatgcatcgaaatgagaattgggagaatggttgatcaggtttggtttctttagaaatctttgacaacaaatgttggccgatatcatataaagaggagaatcatcagggtcctaagtggagtacaacttgtacatcgtttttggttaaatccaccaacagcggcggtccttccaattcaaatgagagatcactggtgtccctccaaaagagaagaaaattcaatagagatttcagattcaaacctcagataaggctggcatccatttcccgtacagattggaaaaatgaggtattgatgtacggcttgctgggaatctttcgatgtgagaagaacatatcacgtggatgagtccatctacttcgaggaacataaactaattgcaatcattggaagataaataatcatccacgctacaataagaccagggaatcatccatcaataattcaatattgttttgaccaagataatacttatctactcattgagtaaatgtcatcctaagtccgcaaacactcggaggatccaggaacctgtttaaattaatggttaattatcagatgctgtatctctataaataatatataccatgcaatgaatcttgcttagatccaagtaaggcatttagatttcttaaggtacgcttgggtttgtcaccaatccaaaaacacaaccatgctataatcccgaacattatcgagggtgttccatatttatctccaagtcagaagaagttactagtattagctcaagttttgaggaaacatttattagtaaaagttcatgttaaaattttctttttacttcttaatctcccattggcaagattgattcctacctatgaattaatatccaattgcaagcacatggagactttaaaagtgtgctagatgcaaaggtcttccgaaattagggggacatttcacgtgttggatgccaatttggagaataatgtgatccatgtgccccctggtatgttcagaatgcatgtacagggcctcatctcacggatcttgcctcctctttgcctaaactcataccccaccctcaccacctccacgtccttcccctatatatacagacagagggaggtattagattcattccatcctcctgagataattgagctcatgggttcttgggttcgcaccatcacctctcccttcagaaaagcttgcactctcttcagcccacccagggacaagaagtctcagacaactggtttgtctcttcatggctgtgtgtcatggacttgcaaaaactatatacgtacgtaggtgtgacctctttgcaacttgttgcaggatatgatcaccatggcttgaagcttcatggggaggtgatggcctgttcgtatgaggatgtccgagtgatgtggtccatcctggacaaatcaaggcccagaaaccacgactcacgctcttgaggcggttacaatggtcgcccagatgagtatatatgcagaaagaagaacacagtaccagggcatgcaaatgcatctttacacaagagcgcataggtatgtaaatcgatcatagtttgatcggaaaggagaggtatgaaggagaagctggaaatttgtcttctttattagtttcagggagatgacaactccttgtaattgtactttgccatgttgctttaattgaatccccatggaacttgttaaatttgaaatttccatggtgagatttggtaaacttttggtttgtatgatgtacatgtgcttttagtaaaaaacgcattactaattgattccccccctcaaaaagaaagaagcgttaagcattacagtttgaaatgaaaatggtcaaaatgattgtggattgtttcttcctctctttcctataaataaacaaaaagaaggaaaaagagggaggagtatatctataccagcttaaataaaaacattgttgtataattctcggttccgttttgtgaaggagagacaccaagctatggcaatactacaaattagaattgatcacttaagtaggatcggacgagctttcagttaacagtagggctaaatgctagcatatcactcttacaaaatcttgtcatattatgcatcccaatcaatacgcacctggtacatctgacatgcaaacttacaatgattcatgtatcatttttctttcccgttttctttgtgaagttacatgatgttttgctttagtgcattatgtctaaacccaacgaattatgtggatgtagagagtataaacatgcgactcggtgcaactcatttagtttggagctgaatctgagctgttcatgaacaactcatattcagggccctttttctgaatttggttacaattaagatctatttggacgcctgcatgtatcatccatcagataaacaccaaaatgaattgaattcagatgaaacacagcagtaggaaagaagaatacgatcgatgcaattaaggaagctctctgatcatctaatctacaaaaagagggacgtgatcagattccatgtagaggtgatttccggcattccatgacttctgggattctataatcaacagagtttcctcaataagaaggaatcattcattttttcctctaacttctcgccataacctataaaaagtatacatacatacatacacacatacatacatatatggatgtatgcatatatgcgtgcatgtgtgttcacacgtgcatgtgcatggcatgtctatatatacatgcacatataaatatatgcatagcatgcatatagtttttttatattcatgtcccacaaaatggacaagcccgtacatgtatgtaaagatgcatggaattacaagtcccttagctgtgcattgcaactttctttccaatcttgctctacagagttaataaacttaagtggatccttggcttatatgtgtcgtgtgtcctctccctcttttggtctggatacgttatacatgataagatatcccttaccatgtcccatgcatattctcctcccattctacttctacaatttttttaataacctctgattgctaacaagagggatgtgattgggggcaagacgtagcacacaatatccttttactattattgcaatattgtgaatatatttatttctttgacttgactcgcacatcagtacaatcatgccatctatagattgttccccctaacaatcatccatggaatgctagttgtccgagttaatattgttcggcacatattatcttaattgtaacccaattagcaatcatatagtacacaactaccaatattcatttacatctgatcaattgttaaatttcagtgtatcaatcgatttttcatatgttctaaatttatctacccatgaatattggaagctcttagtcttggaatatctcttcatcccctggattaattgtaacataatagcagataataattaacattttctacccattaagtagaaaaaatacatattgatccggctaataatgacgtacaatctaaatgcatgaaacatttgtttatgtcgaacatgtaggttcttccttctgacaactaatcggttcaatgcttgccattttagttaccgaaaaacacagatatatgtgttcggatgcggctgtatctctttacaaggacgtggtcgataagaatacgtttcattcgcattgatataaacaaaattttcgtttgtaattggtaagaatcaattaatattaatgtttctttacccaaagaaatagttaagattaatgcttctttaccaagaaattagttaagattgtggaatgtttgccttgtgatgctagcataacccggcgtaaaagatcgaaggaccagttttttttggtaatattagtcatagtttcttgatttttggatctaaacgaagagattttccagccagctcataggagaaattttagaaggaaattaaccaccctctagttccttggagaaaacctttcgaggtttagagcacctctttgttgaaaagaggacatccaagaattacgtactggtagatccttctctatgatcacttcgatttaacataaaaattaaaaggagtactgcgtagagatcgatggagacatctagccagctagcgaatcactgctatagtgagaagaaaccatttcacgatttcttaatttatatattgctccgcaagggatcgaagagacggggaagaagatgaccaacatacagagcctaaccacaaaagcaaccatgcacatatatataggacaagtcaagctagctagctacaattattcattaaaagcaaaggacttggagtaggtgaaaaagaaagcagcagcagcagcagctagtagtagtcgtctggatgttcagttcaaagggaagtagcaggggtcaagccatgggttgttggtatggtccatgtagggctgcaccatctcctctccaccaccaaacatcaagttgtcattggggttcatcacctccatgagccagttctgcctctggagcgcctccatggccgcctccagcggcgtcttctccttcatcaccgccatcggtgccggtgcctcgatcggcgcctccagcaccacctgctggctgctggacgccatctgtgccctcaccagccccatcctctcctgcaccgccttcaccttcatctccaccatccacgccaggctggtcgcatcctcgatgcggaggctgtgcaggctcctccccgccaggccttggtacatgagcagcatcgtctccaactcccggttctcgcgctcctgcttccgcagctgctcctgctgcttggcgacgcgctggcggaggaatccttcctggttcatcatcttcttgcactgctccatctccggcatgctcttgaaccgcgccagcaccctcgtcacctccggcaccgacggccacacctccggctgcggctcctgagggccgtacacgatcacgcacgccttcacgtcgcacagcgtcgccagctcgctcaccttcttcatcaaccccttcctcctcttcttgaacgtcgccctcctcgtcgagtcgttggcgatccatgccaggttcaccttcttccttgccatggcgtgggaatattgggagggtaatattcatctggatggtatttatagaacaaagaaaagcgggatcgatacgaagagtaatggcagggattcggtgtaattcagattttttgattggaggattgatgggcttatcgaggtaacaaatcattgggaggatttggaggtattattatcataaagatcggctttaaccgtgtgggatcacaggacagcccgtgatcccccaatttaatccgacataattaagaaggtttaagactgattagatatgcatcttacagccaataatcaactcataatctcttaaatgatataattaagtgggttcgacacttgatgcgatgtgtatcttgcctttaattgaggcatgcatcttccgaatcccgagtcttggaagaatcccgtcttcctagtccgttagggtacgtacgtacgtacgtccaaaagaagctggtgctggaaaatttagaatgtaatttttcagaatccttcctattcctatttgatctcgcataccatatttttgcttctgctgattgatggtcaaatttgctaaaaattaaatgaccaattaaacttaactactgtcgaaaaagattggagaatcaaagattagtcgcaagaagctagaatgaaatacctatgtcgcaaacaacaaattcattatttttctctcaaaaccaaacagattttttcataagatccgaagttgtgcatgttgatgttggcctgcctctatatccatccacctgtcttaattgcaatgctcctagctgccatgagtgctgtaggattaaatttaattagtgcaggccaccttagaatcttactgccattgcatcagaactacttaattgaatttttaatttgaagaggctaaggtgatacacgatttcacatttttaggatggagtttgaatttttccctggtaggagcttcaattagaaatatctagtccacattagttatacctattatgcatggatttctgaaaaataggaacaattattcgatgaactaggtcgagtacaccaaccggtctatatctcgaggcacatgtacggtaaaattaaagatcaaacaaaggtcagaattcatcctattatccaccacatacctttcttgatcgagatttggatggttcactggattcgatccatttaataatttaccaaaatgtagagattattggataagaccatggtgtacatgccatcatctaataatttttcctttctctttacttttttctaattttcttcttattccttttatatccattttattttaatgaaatgtgtaatgatcttttatgatattttatgttgagaaaactcatccaagtagctggatggaattaaggtatgcaggttggtcgagtgaaaaagcaaatcaaaaccccacccctaccttgtgcttcgttgatacatcatccaagctctaaccaaccgtaggtcgaaacccttcatgacgtggtcaacctgatgtttagattccctgacgatcacgccaaaaatggtgcactgtgtcaatatgtctgcaagctagatcgatcatcgtcgatctcttatatatttggctgaccatatgacatgcatgatcatcaccagtaacatttcaattagcaactatctgcaaatcattcaactacttcatcttctaaatgatccagatgtccgagatttccatattatccatccaaggacatttcattttcacttttggtttacaaccttatgccattaatcgtagcagcaatgcggactcatggtccgttttatcaaataagacgcatgttcaaggttgtgttttgagcacggtttgagcttgacttactaactgatcgaagatggtatgttgttgcgtgtccaacaatctggtcgaatttcaatggatagtttgcttccaaatatagtaaagacacgtcctataacatcttgcacacgattaatctagcttttaaatgataaattgtatcacaaggttcttagctagctcttatatcaaagagatcatgcataaataaagtaagatccggaatatttatcttcaaagatccagctaatcagttattatatttccatgttttggatcccatcaactccaggttacaaaagagtaatgattggacagctcctatttgccaaggcaagatatgagtaacgaagtaactaggagtcatatctttctgtagttaacctccaagggctttgtgcaatattcctttcaaagagaacgatatgcatcatattactttggtcatcaattgttatactcagtttgtacctacaaataaagctaaaacaatcaatactgcaggctgagacatgatacaatcatgcaagtttaacaattctgtttgcatagataatttgctgcattctaattttctagggttgaaaccattagattggttgggaagcttggaaactatgagggaagagaaatagaatagactagggagaatgtcatgaagcttggaactaagagagagagagaggagaccgtagaggatagaaaatggagaggaggaagagagggaatagaaaagctccatctatagtaaagcttccacggatcaaattatgcatgcttgttaggaaatacactttaaaatttggtccacattgagcccacagcaaggtataggatgaaaaatggagtccaacgagcccaagatcagcccaattaaagttcgaacgaaaaagatgcacacgagagaaaatggtacgaaatctggagcgacgacggccggcggggtgccgcccggcccggtggagacgcgcccaatgcgtggatatgcccagcgtgggtgcgcacggcctaggcgcggaccgcccagtgcgggcgagtgcgcgggccggcctagtgtgcacaagcaggctagcccagcacgcacaggcgctcggcccagcgctcgcacggtccaccatggactgcggggcactggcggtctgcaggagccgcgtggaccgaagtcacggtccatacgtagttcatgtggatttttacgcgatcgaacggtccaaaatgtagtcgattgcgatcaaacggctatgagcgaattcgagcgtgattaggtgataggggggctattttgtgcgatcggatggctcttgtgcgagctgatcatgatcagacggccacggatgattccaggtttgattgagattttgtttcctactgaaacaatatttttgtgattctggagtgtatataactccgattgacaaaccgtttattgcattgggaagctgatgacgtcctggaggtgcagaaaggcttcaacagaggttttaaagagcttttgtgagagttttgggattttttcttgagagactcttgtacaacgattgagtggtaagttcctcttgtattgatcttattttattctctcatagtgaagcttgcacgccacatggaggtaggtttgagatcgatccacgtatttgtattgtgtttcttattttgtttcttctttcttcttgccgcatcgtatggtactggattctgatgggcgttacaattggtatcagagcaaggtggtgccagagtgtaggctgcagcggtgatgatcgagatagaagatggagaagacaagcacaatcaaattgaagatcaacaggtttgatggaaagagcaatttctctttgtggcaggcaaggatgaaagacgtgctcatccaacaaggattgatcgatgctttcttgtgtgatgagaagccaaccatcatggagatgcagaattggaggcggcaccagatacagacggtgagtactattcgcttgtacctagcggatgaggtggtgatccatgtgcttggcgagacttccccgacgaggctgtggtcgaagctcgaggagttgtacatggcaaagtctctcactaacaccttctttcgatggaggcagttttatcaactgcggatgattgagggatagagcgtgcaggagcatcttagcaactttcagaagatcttcaccgacctcctcaacgttggtgagaaagttgaggagaagaccagagcgctggtcttgctagtgtcgctccccccttcgtatgagtccttggtgactgttcttctagtgaggaagagcaccattaagatggacgaggtcactgtggtgattctccagaacgaggttctaaggagggagaacccagcttcaagctcaagtggtggcagctcagcattagtgatttttggaggagcaagaagcggcagacaggacgacaggagatcacggcgagggcggtccaagtccagaacgagggacttaagcaagaccagatgttatcggtgtgacgagttggggcatctagccagagattgctctcaacttagagatcggacaagtgctactgcagcgacggtcagtagcgattcagaggaagatattttgaagatatctgacgaggaatctacttctttccagcagtggattttagattcggcatgcacctatcatgtatgttgtagagaggagcagtttgactctgtagagagtagtgagagtactgtttatctaccgaatggatcgagctgtgcgatcagaggcatcgaatggtcagctggaggacacacgatggtgcagtgaagagattgggggaggtctgatacatatccgatttcaggtgaaatcttatctcactgagcatactagatttgagaggctacaggatgatagctggtagagaaattctgaaggtgttgagcagcgataggattgttctggaagggaacaagaagacgagaggactttactacctgacagggagtccagtacgaggtggagcttccggagtcaggaggagcccaaagtgaggtggagctctagatggaggtggatcggacacgagacgtaagactcgggaggatgagaggcgatgtcgcagggtgggattcctattaccatatgatgatactccgagcaggtctatggtcagagtggacacagtccatgatggaggtgggatcgagcagcctagcttgactcctacgtttgcctatccatgagatagcaggcatgccctagggtgtgggggtgagacagatcacaagctcttagagataggtgaaggccgaatatcgagtcgagatagagattgttaagaaatacacctcaagattcggtccacattgagcccacagcgaggttcaagatgaaaaatagagtccaacgagcccaagatcagtccagtcggaatctgaacgaagaagatacgcatgagagaagatagcacgaaattcgaagtgacggtgggctggcggagcgccgcttggcccgatggagacgtgcccagaacgcgtacgggcctagcacgggcaggcgcggcccaggcctaggtgggcccagtgcgggcgagcacacgggccggcccagctcgcgtgggtgcccagcccagtgctcgcgtggtccatcgtggaccgtggggcgctagcggtctacgggagttgcgtggatcgaagtcgcggtccatgtgtggttcaggtggatttttgcacgatcggacggctcagaacgtagctgatcacgatcagacggctatgggcaaatccgagcatgatcagatgatcagggagggtattttgcatgatcggacggctctgatgcgagccggtcacgatcggagagccacggatgatttcaagtttgattaggactctgtttcctactgaaacagtatttttgtgattttgaagtttatataactttgattgacgaaccatttattgtgttgagaagctggtgatgtcctggaggtacagaaagacttcaacaatggtttcagagagctttgtgtgagggttttgaaattttttttgaaaaactcttgtacaaggattgagtgatgagttcctcttgtattgatcttattttattctcttatagtgaagtttgcacgttccgtggaagtagacttgagatcaatctacgtatttatattatatatatatatatatatattttttttttttttcttcttgtaccatatgatatcggaaatcctgatgggcgctgcagctttaagatccaagcaactgaagtttcaagggaccgataagctgtggtctttttgctttttgttgctctgccatggagccatcggtgggaaagaaatttttggatctttttaaataagagatcctccccctccttaatttattgtacttaaagctctacatctctgcaataattggttgatcctttgttcttagaaggagcttcctcgtttctctaagttgtggcacaatatcaaggacttctaggtgctagtataatctgttgttgatctttatttgctgatgttgttgttataaaatattgatgtttttggatatgatgaggccgagaaaggtattgtctagactttgatccgttttcacgatggacatgatgatctaactctctttctaatctagagtgtttttttttagctgatggtcactttcttagttaatggtcactttctcctgagcaagatctgagcctaattttgtttttctaatggattgtattattgatagctgaaacttattggggtatatttggagcttcgtctatctttggctaccatatctgatggtccctccatcttttgtttcttctaatttcagagatgatgatgaagaatctttgcatcaatgtgtggactttgtggtccaatttggctacaaatggcaatagcgatctcttttgattgctgtttggtctccttcttaataattcatctgtgtcttatttttacggttttcattttggtttttttcttttaggcatgctccttgtcttttaatggtgctcatagctctcgtaacttgtaaattcctcttatatgttcatatgcaaataaacctggtgactaatgattttatatcattagtctccatcttttacaaaaaaaaaaaggagaggggatagtgagtaatttataaaattttgatgcatctatggcaaataaaatttttgccatccagtcgtaacgaatattcttagaccttggactgctttttaatctctatagggtacagtactaaagataacatctgactactatgatgaagactctcccattccaactccacctatttgaaccttactatgtcatcttttgtttgaattctaagcccttccggttattggggatccatcttgatagattctactatttcaatgcctttttgggatgctagagatctttctcggtacaagaaacgccctcgcgcttcgttttccccatattttggtctctctcaaatcatgttttcaaacacatgcacagtactacttaggtagcaatgttgatgaagggcaattgtagcaattaaataatattaccgaaatcatgtcgtatataagtgcagctataggtgtcccggagctgcaataagaacacggaaggacggtaaatagcccagccaggtaacccaccaggtaaaatcatgttgggagcgcatgtatctggatggtaaattgcttgggtttatttgggctgattgggctctcttactctccctcctctcgactttatttttaattttttttctctttcttcttgcccccatcaaataaaataagaagatatttggttcgcaattaaaatcgaaatcgaaatcggaataggaatgaattggaaccagaatcggaataatcaaatcatctaaaacgtttggatcgtgatcagaatcggaatcggaatggatgattttcattattgttgcttggttcatacaaagatagaaatcagagtcaactcaaatttttatttttttcttaactaaaatttataaaaattaattattttaaaaattgatattaaataaaaattaaacataataataatatctttaaattttttatttaaaaatatctatctagaaaatccttctacaaagcttcctcgaagctccctcccccaccactccgctcttcaaagaagaaaagccattcaatctctcacagcgatgcctctttcgcctccaccaccacctcctcatccgaagactctacatcctcccgccttcggtccaccccctgctccgtcctccccccttcggtcggcaagactccctccttcggattcgatgacctttggctcctctcccccatcttctcctccgtcttcgacctcttcgccgtcttcaaccgtgtcgatggcgatggcaagatcacaccgcacgagctgaaagccatcctccaccgtcttgacagtgtcgatctgtccatcgaggaggaggtagcgtcgatggtggtagaggtcgaccgcgatgacaacaggtgcatcagcttggaggacaaagggtgtatgcttgaggattgtcgtaggtaagtgagagttggatggataatttttttttttatctcattccattgaaataagattttgattttattagggtgagtccggattcaattatgaaaaaaatgaattattttcattcttctctgaaatgagaatcgaaatgaaacttcttccaatcaaacagttagaatagagatcattcatttcgacttttattctaaatcttaattactccaatcaaatactcctcaagcggtggttttttttattatattttttgaagaaaaaacgaaaatataagatgcgttggaccccagtggggcttaaaatgtatatttatgtgcgactatagagtgcagggtccggtaaacaaagctaaccaaaagccaacctagtacttccttgatacatcgtgcaaggtgaccgcggaccaaaacacatcaccacttggccaatttgactcctttgttaggtcgtgcaaacatatataaaaatatttggtgtccacgagagccacacaaagatggtgcgctgtgttgacatttgcactacagaatgcgacatgcccactcgctagctagctacaaaggtcgccctttccgagcttttggctgagggagaagagagctagggtcagcacctcataccatttgacatggtcatcaccagtatacctttctcagccttttggctcagatcaagtgcggacatggtcatcaccgataacatcttatttaccaactataatcaaatcaattgtccgttaccattaaatactgctgccggcaagcacagtgaccagagtcattcaactggggcatcttctaaatgaccaagatgatccggagctttcatctttcatgtttggcgtggtaaacgtaccttaagctatcaattatatataagagctaagtcaatgcaagctcggttcaaccaaatcagaagcatttttcaagatttgcccacgcttgcgttgggcttcgagcgagaattgagctcaactcactttctaataaaaaagggatgtaattggatgtccaacgatctagttgaacttccaatcgaaagtttgcttcctaatgtagtaaagatacatcctcaagcatcttaagcatcattaatttcggcttttaaatgataaattgtatcccaaggttcttagctcttatatttcaaagatatgaataaataaataaataaataaataaaaaagcagatccgttattgaaggctactataataatacaagaatgaattgccattatgtgattattgtcaaacaaccgaggcaaattaattagctcaaggttcgtgcactccacgttcgatgtgcgtttgctccaactacgccgggattttcctgtcgccttctggaatcccgttttccatgcatgagcccttctaggtagtgggatcggcactcagagcccaacttgatctgggctctttgaaaaagtcaacgcgtacatcatggtcaaagtcgaccacccattttgggtgtttacttccaacgccctttggtcatttccatcttttcttcagcacgcctaaaattgatgcaacaaaaactatgataaaatattgcgcaagagagagttatatatacatccctctcatgaagaagccatttatcccttcaaagccatggcttctactattattagcagctctagctctcctcctcttatcttatccttactcctcttcttctcttcttccaatattcttccctttatttcctatgccgaggctcgccacgttccttatgctccccatatcttatcaatcgtctccaaggagctcttcaactctatatttctccacaaagatgatagtgcctgccctgctaaagggttctacacctactcctcttttgttcaagcaaccaaatgcttcccaaggtttggtaacactggggacttagctacccgaaagcgcgaggttgctgcatttctcgctcagatctcccacgagacaacaggtatatacatcaaccttggattcatacatacatgcatgcatgcatgtgtacttgtatacatatatatatataagcttctagcttcatccatgggaacaagtggatatatatgatgatctaattcattgtgtgggtaatttgcgtccctattaggagggtgggcaacggcaccggatggtccttatgcttggggtctatgcttcaaggaagaggtgagcccacagagcaactactgcgactccacgaacaagcaatggccttgctatcctggcgagtcctacaagggaagaggacccatccaactctcatggtaagataaattgacctcccgaaaaaagtttgccattgagaactcatttatctgaactaagtagttgaaacccacacctatagaccaactgatgaagggtagtttccacagcttgtgacactcttgacactggttggatttgatatgctctaattgtatagctcaaaacaatggaccctggcaggaactacaactatgggccagctggacgggccttgggatttgatggtctgaaaaatccggagatcgtagcaaataactcggtgatcgcattcaagacggcgttatggttctggatgacggaacagaagccgaagccgtcgtgccacgacgtgatggtgggccgttaccggcccacggaggcggacctggaggcgaaccggaccgccgggttcgggctggtgacgaacataataaatggtgggctggagtgcggaattccggacgacagccgggtcaacgaccggatcggcttctacaggagatacgcccagttgctagacgtggatgtggggtccaatttggattgtgccaatcaaaagcccttctagctggttatcggaatttttggtcctttttgtctttgacccttagattaataatactgcatggtttagggcttgatcagcaaataaaaagatcaaaagccgatatttgttatcgataattctaatgaatttagaaaaaaaaaaaagttagatggtgaaaatcttaggtgatgtaagggatgtaaggcttgaactatgtcataattctgcaattcctatggccttggtttacgtatttatctacttttctggtagacgagctgcatatttgacctcttaaattagccgttcgatggttggctgaggctggagttgctgtgcctgctagaggttccagattgtaaaatttaatgccatctaattaaaccttttgaaaccgcattgatgaatggtggaacaaggctcagcctccgcccgtgtattgcatgatggcggtgaattgcataagaaagaacagtacgtacggtacagcacaggttgccatctgatctattcggtgggcccgacggagaacactatgggcgacttcgtgcgaagaggaggtagcttggaaaagcagcgcagaccgacgcaagggagggagccttcgtgcgttctcctgctcgcacgattagattctttccgtgcgctttgttatgtaaggatacaattgtaattctatgattttgtcgcgagtattttggatgaaaggtaaaattttataaagcccaaaaaaaaaaagcttcacgatctctctctctctctctttcttttttttcttttttttttcctaagagaagctccgtgggcccttttagctgcttagtacggagctaaaacaacttccttatttttttcccaaaacatactaaaatcatccaaaatacttttgaaagacaaaaaatacttcctctctctccaaacactttactaaatataactcaaaagactaataatcctcgattcatacgaggatcccagctcctataagccccttgttcccagagaaggtgaaatctaatactaactagggttttatgtatcaatatattctgccagtaaaatatccaaaaaaaatattttatttttaaaatcagataattcttcaagctctatattattccaccaccctctaagagccctaattgatcaagtccaaaatcttttatttaagtttcagaatgattgatcgatatgaaagttttcttttcgaaaaagagtttattcaaatgtatgttccaattatttgaaaaatattagactggtcggttgtagataagattgtctctttcatcttgtacattcttataacctttttttctaataaaagttgggtggtagttctccactgcttcccttttaatcaaaaaaaaaaaaaaaggaagttgagatttacctcctttgagattttagctctttcaatactactatttcccatggttatatctatttcaaaaaaattatattatcttttaacgaaaaaaaaatccaattcaaattatacaagaatgtacctcaatagtataaatagagacaatgtaagccaatttgttaacttatgaatgaaaaaaaaaaagaatgtagatctacttttgtcctttttttttatttttctaaatttctttaaaaattttgagttgactcgattgcaagatttgcttttcctcgactagatcatccagcaaaatgactctctttctgtgaactatgcaaagtttgtcatgcttctcgcaacctcctaaattcctgaatgcttctctatccatgcatatggggcttcactattttatggtatctcctcaatccttgtcatgattgttttcctttcattgtttacttttggtatgttgtttttcacaatgcttcttaaatcatccaaaccattcttcagaagaacataatctaagtaaattgtcctttaaatatcgaggctaactacctttcttcttatttcactttaaaaataccatatcttggtagttagaatggtgccaatgagcccaaatttctcaatgattcatgcttttcacaaagacatcttccaccatgcctgtaggattcattgaaaatttgaaatttctatttcataaaagatttaaattttaagtggaaccttatctcctccttttagatatttcgaaagttttaaaatttttcttttttttttggttttttagttccacattgaatgtgtaaaagtaagttctcttcctttttatagaaggccttaaaatgagttacattgctttcaaatagagcctttttccgaacagagcctataaaaaggctctaggtctatggtcttgaataatcacatcacatgctaagttcaagatagagaaagctcttccctatgcttttctacttattcaccattgtcttcctttttttgcaatcttttctccttgaggagctggttctttatggatgtaggttgtatcttttacgcgaaaaaataattgatcttcttttatagtgcgaaacgttggattgcactttgattaagggagccagctttttctacaaatatagcattattctaatagcacacagtatccaatataccaataattctttttagataatttaaatctaagcaaatttggatagagtattggttgccataactattagcaaaattaatatgtttcctatgagaacgatctacattataataggattctagtaatggcgtcaacaaaacattggaggctgaccgaccatgtccatgaagagtagaatgaccatacatacaaggggcacatgatggtttcacgtgagggtatgcatacataattggtgaagcctttcacagaccaaagatgctcgagtacgtgcatgcgaggcaatctgaccaactcgcacgtggcacgtggacagttgacgtccctcgtttttaaatagttagcacatgttgacttatttatgttccaagtaacggtataatggcggttatatcggtcttcgcctacctcattatttcatatatatatatatatatatatatatattgtatgtatgtatgtatgtatgtaaatatatgataaggagagaaacacaacagcttttcatttaacattgattatgatagtccgttattttaacttcctcctttttgtcccaatagaatattatttttaatttttttactaaaaagtttgaaatgctatcattgacgtaaattatagtcagaaaaaattacagcgatattccttaaattttgacctatttacgtttgcactccaaaagaaaaagattttaaataaaccctaaaatttaaaaaagttgcaaagaggctcaatcaattgtctccaacttaacaacattaataaaaaagatgaaataactaaaataccctcaattcacactccacaatgatttttttgataacttttctctttgttcatttgaatactttttgagtcctcacggatgcccacctcttccccactctccttgctgccacctccgtcaatctgcgtcaccatcttcctcccaattgtcaccattatcgactttctcccaccaatctccctcaattgctttcatttccacagatcaccgaaaactaaagatgccgacctcctccttgctcttctcgccaccatcttccgtcagtctctactgtcgccttcctccccattgttattggtattggctttccccctctaatctccctcaaatatattccttcccatagatcttcgaaaaagagagacatcgacctcctccctgctcttttcgctgccatcgcccgctaatctccattgtcgtcttcctccccattgtcaccagcattggccttccactccgatgtccttcaggtgcatttctttccatagatctttgaaaaaaaaaaagaaagtagaaaaaaaagaggaaaaaaaaatgatcaatctatgtggaaaaaggtcatgccttttaacttttccaccattctttaatttttgttaatatttttatattttttgattttttttgattttttttattcttaaaaatctctatcaaaccacgtgttgagttttgatcatgctaaaatcaagaaacttctaaaaagaacatttatgttgcctaatggagatgggcggtggtatttttttataattttttttaaaatttcgagatctatttgatttttttcttaaaatttaaatataaatggatcaaaatttaagagtatcattataattttttataaatattataatgatgataggagttatggtgacggcccatcgtaatagataatgtgttatttaaaatcttgatttagtcttttcccaaaaaaaaaaattcttgatttagttttttatgttggtgcttgatcactccatgtcaccgaaaggcaaaagtatggtgcattatcagccatggtgtggtgagaggtgtaattgagcttgagcttatctgagcttgaatgtgatcaagctccacataactttttttttgacgcatgaagtttgtgaccaagattagctcatttatcatattattaagcttaatttggaattgaattaaagataaatctattttgataagtttgatagtcttcacttttttttttgagaagcaatagtcttaaactaagttgaaatcagcttgagcttataacaaactcgatgcaagctcactaaaacatgaattaccattcaggctcatcagttctatactcgattgttctttttaattttttcttaatggaaagatgaagggcagtcactacatttagtgtaacaattgattatatatgaacacataaagcattcatgctggaatatattaaaacatattttgagtcttatcctgcaaagcatgatctacttgggtttacttccaactttgcttgaagttcaagtctaaggttcaagcttggtttaaccatatatatttgatccaagtttgatagagcttattttgagccaagattaagctaagcttgagccactcatattaatcaattggtaattttatttaggtcagatgatgtgcatttcagccagagattttcaaaagcatgattgtggccatattgatgggcggctagttttgagataaaccattatcttggattatttttacttaaatagagagatgagtgttgatccaataattaattttgataaatataaaatatttgaatattttttttatactaatatattattgaagttcatattaagaatatttgaggaagctacagtcactcttagcaagtatttcatcaatgccaagttatagagtgtaaaaaaaagatggaagaagccacatcatgagaaatcaaatgaaaaaagtcaagagctgaccctaagtttcaaagagtcgaatctggcatataaatataaaatgacatagtttgaaagtcgatctctacttttgttgagtcgactctctcaaatagatagagagtaaaatttttcagtactagcatcgagtcgatccttagtctcaagtcgattcttttagaaaaaatagagaactatgtttttctgagcaaactttgagttgattcctacttttacagaattgactcgtagttagctcaaatcaatccttatttgatctcgagtcgactcgactgcggttaacaacttttatggctagttctgcataaatttcagaaatatacaaattgagtttaatggctagtttttgattttcaatagctaagaatggctttttgaatatatattttaaaagattgtaaaggctaccaaacaaggagaagagttaagaaaaagacaaaaacaaaaagaaaattccagtacattaagtgagtatttaaaaaagagtttcaaactttcaaccatcaaattcttaaagcattcaagtgattttgagtgcattgattgtcaagcttcttggatacaatcttcaagagcttcattatctttttaattggtttttttaggagcttttattgtattgttcattatatctaattctatattataaataagttttaattgggattgaaatatgaaagtaggcccatccaagccttgaattggagtatgcctattttgtgagtctagagttagcttgtggatatagttttggttgattctactaaaaaaatcaattgggtttgattgttagttaagaaaaataatcaagctataatctgaggaaaaatcataataaaatttttaaggatggtttgaggaataaatataggtgctaagtttgacgctgaatcactataaatttttttgtatttgcttgtgtcttattatttactttttatttctcattgattgcatttttatatttttgtttatcacatagctttcactcacatcgtttgaattagcttaattattgtatacaataagttttaatttttttaaaaaatctaatccattccgtcccttaggttgtttagctgggcaacagtaaaaataatggcaaagatcaaaaaatataaagcactaaattcttggcaacatcaatgtaacatttaaaggcattaggtcgaatgtttaataccatgtccctttttttttggtccattagtcaaatgatcttaaacagcttaggttctagacattgcattgctaatcttttttgtcacacacacacacacaatttgacccactttcacatagtaatgttgtcaacctcaaagtggaagcatttaagacgtaactgataaacagataccagattccacataaacaatatcgtgtgaccattggcttaatccaggaaaaaaatttctcatttgatttcttctggccatctaatcagtaatcaacgcatgctttcttttaccttaattttccttttatttcgggaaggagatggaagattgagtagtgggatataccacatctaagtactcggagaaacacattcaagtttcaaagaacttagaacttccttcgtttggaacaatttagcagccaatgtgctgtttcttgattcacacctataatcagcatgcaaaaggatcaatttgatcgcttgtatatatatatatatataaagcaacctcatgttttatatttttccccgtatacaaactaattggcagaatgatatgctataagatgatatacgatagactatcaaactactaaaatgcaaacttatatgcaataatttacatgaattctcagagcgtctattggtttggtggtggttagtggcgccaagtgctaagccactaagtagaccacaattcaatatcctttttatttgtttcccgatgtaacaggaggcatagccatccaaattttaaattttattactgataaagaataagtagatacatacaaagcgaaataaggctgaaaaattagcagagagaagcagacttaattatgtcgaggggagggaaactaaaatagaatacagtttcccacaacattattgaagaaaagatgaataaaagaccaaatcaagtggaaaactggagatgcaagcataaccgaagcacggcggatatgcttattatgctctaccaaagcattctgttccagagggcagctacacatattgtcactgtccacaatatattcccccaatctctatccttactaattacacactaattataccaagggcaggcatcatgagagtctccttctcccccttgaacccctccaaagcccattctccaagcatccaattcttccacccaccaagcgctcagctaagatgcacctcccaccaagtccatcaccacctcagctccaccctcactcccacccacctccacaccctcctaactaccaccacaaacaaccatcccaacccaaaccatgccacccaaatccatgcccagctcattaccaccaactctctccccatccccctcctccacacccagcttatcaacctctacgccaagtccggccagctcccccaagccctcctcaccttcaaaaccacccaaaaacacagcaacatcgtcacctggacctcccttatcacccacttggcccaatcccaccaaccatttgaggccctctcactctttgcccgattaaagagggaaggcctcggtcccaacccctataccttttccgccatcctccctgcttgcgccgaaacacgctccgtcttgcatggctcgcaggtgcatgggcttgcatgcaagcacggcgtcgacgccgacgtctttgttgcgagtgcgttggctgatatgtatgccaaatgtggtgatatgaatgcatccgagagtctgtttgatgaaatgcctcagagaaaccgtgtatcgtggaattccatgattgtggggtttgtgagaaacaagctttatgacaaggcaatatggatgtttcgggctttgcttatggatggatcggtgagcccagatcaagtgagcatttctagtgttttgactgcctgcgcaaactctgggggattgggtttcggccgacgagtgcatgcgcatgtggttaagcttggattggagtcggtagcttatgtcaagaactcgctaatggatatgtacagcaaatgtgggcggtttgaagaggctttggggttgtttgatattatgaatgagagagatgttgtcacttggaataccatgatgatgggctgggtcctaaatgaccactttgaagaagcttgcagctgtttccaggcgatgatgagagaagaaattctccctgatgaggctaccttttcgacagtcctccatgcttcagccagcctagcagcatggggccagggggctgcaattcacaccctgatcataaaaagcgggttcggtaacaaccagtgcgtcgggagctccttgataaccatgtatgccaaatgtggcagcttggatgatgcgtatcgatcgtttcaggagatgaaacaccatcaaaatgtggtgtcgtggacagccatgattgcagccttccagcagcatgggcatggtaaccgtgtcatcgaattgtttgacaggatgttggaagaggggatggaaccagattacataacatttgtttgcgttcttgcagcctgtagccacaatgggcttacggaacagggattcagatacttcaagtcaatgtctcaggttcacaatatggcaccggggaatgagcattatgcttgcatggttgatatgcttggccgagctggccgtttggctgaagcgaagcagttcattgatacgatgccggtcaagcctgatgcttcggtatggggagctctgcttggagcttgcgataagagcggaaatctggagctgggaaaagaagttgctcagagattattcgagatcgaaccagataaccctggaaactatgtgcttctttcaaacttgtatgtgagacatgggaggttggaggaggccaaggaggtcaggatattgatggggtacaatggcgtgaggaaggagactggttgcagctggattgatgtcaagaacaagacgtatgtgtttacagtgcacgaccaatcccatccgaggacacgggagatttatgagatgttgcgaaggatggaggagctggtgagggtgaagggatatgtggctgacatccagtgtgctgtcaatgatgtaggagagtacaaggagcagagtttatggtatcatagtgagaggctggcactggcattcgggctgataagtttgcccatggatgcaccgatccggataaagaagaaccttaggacttgtggggattgccatactgttatgaagcttgcttctgggatcttcagtcgggagattgtattaagagatacaaaccgctttcatcggtttgccggtggatcatgttcttgtggggattactggtgaaaaaagaagtgaatctggatgtgctcacccctggatgccaagaaggcataattgggggatgaaagttagatcgttctgcgatccagcaacaaattcatatatgggaaagaagtaacaaaaaggaagcaagaccggataaatctaattgatagaggtggctgtgtgtgctgcaatgaggaccaccacagtctgaacatcacaatctgaagtttttctatacacaaaactttgccctcaaagttactcttcttccaagtattcttagctaatttcaagcaggaagcaattatctagcagtggaacatcatcacaatgggtaaggattctaaaattatccaccccatataactatgtaaaannnnnnnnnnnnnnnnnnnnttgacaattatctaagccagttatattcacagccagctgcccaatttggcagcagggaatctttcttgcaaacaacagttttctttatgacattacagagtatatttgtgagtccaaggtcatgtaaaaacagcagcatcgccttgtgaagctcaaattggtaggacaaccttcagcttatggtgtgcaggtgtcccggattcctggtatcattgttcgtgcagctcagcaatggggtgggaatagtgtatttggaagctgtcttctttctcagccctgttttttgtttaatctgtacaagatagaatagcccaaaaataagtaccaatccaggcttaaaaatttgagcgaacaggagaattgcataataaactttaccgatatcctatagttagtagtgcagggcgtttgccccgtgatctcacccctccaaatggaaaatgaaagttttgtattctgggggtgcttccttcaatcttcaattctaggtaattccaacaggtaccgtctccctcccttgcttttatttttgtgtgtacgtgagtacgtgtgtgtgtgtgagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagactcacctgtaacagccagagagagagtaacctgtagcagcctggtaataagccacggaatgcttgaaccttggaatccagtttcgtaacaggaaatctgcggagggtgaaaggaatggtaatgttgtatgtaattgatattgaagtcattattctcaactaaacctatggatatatgcaggtggtacactaaaaagtcttctcttagagtgaaacggcagccaactatcctacacaattctatattattttcttggaagccaccatccctctccctttcctcgagaccaattttgatcatagtgtaatggatggagatgttttttttgttgagctggctttcttattcgaagtaccagtggtgtactgatagatggtaataggtggcgtcgggatttttgatactacggtttcaatggtgcaattgtgtggcctaggaaggattgaattatgctatatagacattgagagcttcacaaatgtatttagaatgagactagatgattgttattagatggctttctgatccatcttgtgctgatggaagtctctattcatttttacaagattgttgaagaatgatgtatccattgctatctttttaaagtttcatatatttataaagaacctaacagtgctaccatatggttttttatgtggcaaactatatcagttctatctttgagattttttagctaatctttctgttcagttcttaaatattttttttctgatttttatgggtatatttattcttgattgatttaagtcatctgttttattcaaaaaaatagagttggaaaaaattatttgatagtagaggaaaaatcagatctttgaggctgaattgtgaaaagggcatcgatctttcccccaaaatgctgagcttttttgacaacatataatgatgtccaatatcctacttacaaatcaaaacaccacctctccataggcacattccatatgtgcggttaatatactcatcgatcatttagctctcctcttgcatcaagagctccaacttcttgatttgacaatcatgggctcacaagtaccaccattttccccattcatagaacaatatttcattataatttggtagtcttgattaagtaaacttttatgactagctcataaaataagttcatgctggtctcctattcttttatacctaaatgctcaaggtatgcttcctcatatacaagccttctggactgcatggagaaagggattaatctggctaagattctagaaagggataggtccaattggctctctccattatgtgacacatatggtacgagcggaactctagaatcttcttgaaaaataaaaatgacggtagtttcgattcgtgtaaggctttgtatgcattcttttattggaggaatctatgcttcgaaaatgttttagaaagccacaaaactattttgagctggttgtccctcttactgtaactgtctcctgttcattataccattccctccttattccatctgtaaatttcctctgggagaagtttctcacctcctccacttttccctaaaaaaaaaaaaaaaaaaaacccaagttgttccatcaaagtggatatgacaatgttgaaaatttgtatagttggcaagtaatacaaggtacatatgtaaagtcatcacccccaaccgaacccccacagacatgcagggcttgtcgcttaggactacagaatgtcaacaagagaagatagatgggtgcaggatgctgatggcatgtggtgattgaaacaggcagtgtgcattgcctttgtacaacctaaggccgacaaaatcaactttagatgtgaagttacatccatcatgttggattccttgagcctcatgatgtgaaactttggaatagtatatgctagttgttgtatatatttgcgtaataattgccctcacgagtctttttgcttcgattctctctcaattttctagtagacacttcctttttggccactaggtagaaagctttagacatcaatcttaacaaatggcatttcctttttggccacataatttcagcgtatccaaggcgccattccctgctcaccgcaaaaaaaacagtcatttctttggggggaaaaaaatctttagagagagagagaaaaaaaagcagcagcaagaaaacaatagcggatactagagaagattgactgagaaaatccaacattacctatttttaacatgttctgcttcattgctaccctttttgctcgctctggtttttcttgcaaaaaaacacatgggagttgcaagctattgtgtgaaagattggagtcctgatcctctaccgtccatcttccgcaccgcaagaagagctttggatgcttggactgctgtcgtattgccccacctctgaaatggagggctctcgcacatcctctatcccgagtttttggcaactattcacgtatttggcatctccactccgatgctctccattgctgagatgaatgagctctctccatttctgagatggatgacatggtggtgatcgacaggatctatgctcaaaagaacatggcatatacgagaggaaccaatgatctatggatatgaactgctgattgtcaaagccatgggaatagtcataagtatcatattgaatgttttatctgtattatatgcacgcacagagacactcaaatcttttatcgtacaaaatagcaggagtagacttcaagggtattttttgagtatttcatctctttatactcaaaaactcaggaccaagtccagtctggccccaatcaggctaaaatgtattttttgggcctcgccaaaccattgggacccgttcatatgacacaaattctggctcaggctcttcatcagattggcctcgtccatcaacagtcctaaacctaagaggttttacataatatttacaagagcccacgaactcaaggttgaaccctcaaatgcgccagctgtcaaaactatagcatggttaggtggcatatctttgtgatcggtgagatttaggtgcgagcatcatctagtctgctatcattccttcaaccgaccgataggtctcacatactcgatctgtatcacattctttcgacttgtgttgtaaagtatgggactgatttaattgcgttaattttgatctatattctacgaaggtgtgttagaaaccaactagacccttttactagtcctttcaaaaaaatgatttcagatccaccaaatggatcaaatcttctatacatcgcatcttataatttatactttcaggtcccataatgctttcattccttcagtaaacagcaatgagtggctgattgacaagtgattcctatgctggctgctgacttcattagttctttctgctttcagctagagtctgtgggctacaaagataagaaccatattaaacttagggagtccattctgatgacacaaggcaggcaatagtatttgcatcttgctctcaactaagaataaaagaattcaagaataagtaattttttccaacttccagaagtcacctgcatacagctcaggagagtgcaaacaaatgatgattaactctatatggattattccttctatgtttcagaagcataatgatgagaacatggtccgctggatgcttaaagagaaagatttgcaccccacaataatgttatggacaacaaaagcgacaaatattgttgcttgtttggattatatgacaaggttgaagagatggatccagttggatgaagtctgctgtgtcaacaaaaagtctactatttcaacaaatctatcagctagctcattcatcatttttgttgtttttggtctggaagaagtcttctatttcaaatgcaagctggaaacttattgttatcaatctttcttacttttggttggccgtatttatatctgtcatttctatcacaaacgtgcatgtaattttttttttttattaaaaaaatttagacgggcattccctcacttttgtttattattgtaaggatccggattttcttaattctctagcacaaattttaaaggattgaaaaggaagaaaagaggaatcacgtacttggcacgtgaggggaggggaggaagagggctacaatcggaattttatttttctcctaatttgttattaaaaatcagaaataatctcactaaaacttggattaaaatgactccaattcttatttacaaatgctgatccctcttccttggatttccaccataatttttttgaaaaattattgtcggtttcgagcccttatccgagtatttccttgggttttcatcggagaaatcattaggtttttcttgtttatcctcgttagacctaggtaagttattaagcctttaatttttcttcttttttgagtttgttgctgctgattggagccgatgaactgatagatttggacaagaatagggttttctctgttttgagttttcttcctctattttatagatcatcgactgctacggctactgttggagatacgtttcagtaggcaccgagtgctgacattggttgctggctagtattctacggccatggccagatgaagagggaaaaagaataaaatttgggtgctttgtttaaagaagagagaaagggagaaggctgcctctcttctctctctctcccctcttttatataatttctctcttctctctctcactaagttgagaaaataaaaaaaaaaagaagaggttctcctcttttctctttcctctctttctctctctagattttttctctctcttcatggattttttctctagagatcttatagaccagtggaaggtacaagtacttaggtaacccagatcaattggtgaccctgagagaggttctggactagtagtgttatggccatcttttgtaatttttattattcatgattatctaaaatttttatgttgatcttgaaaatgtagaggttcaactatttgcataagaagatgtcaagtggaacatcttgtttttgagttcgtagatcgagaagttcattagtttctgtatttggatcaagcaccgatagagataaggattgttggacacaaataatattatgtatatttatttttttcattatatgattttgatttttcattactgttatttattttatgattatcagtataattatttgaattttttatgtcatatgctcgtatcaaatatggaaggttttcagatggtttaggtaataatactgaaaattaaaaattttgaaaagaatataatatgatacaatattttcttgatataattgaaatttaataaattgatgattaagaaagggatatttggattaggcacgttagattgcgaatagtcttgtcatggatagaaatgtgatactaagaatagctcgtcatggacagaaatatggtactgagaatagccccatcacggtcaggaacgtggtactgagaatagcttatcataaacagaaatattgtactgaaaatagccctgtcacggacaaaaatatgatactaagaatagccctactattggtaagaacgtgatacttgagtttgccagtcatggatttgagcatgatcgtcattagttcagaatcctaaagataactgttaattgattcagattatgttaatgtggatgatatgatatgaaatcataattaagtaaaaaaaattacttaattatatatatatatatggtataatagtttgaagaagagggatatccgatgatatatgatatatatttttgtatatgttggtactgagttatattggatacatgatacgaggttttatagcttatattttcttttgatactattcattcgttatttttaaattattattatattggtgtgagtatgtaaggattattattagattgtaaagttcataattcttttcttttcttttttaaaattataggatgttcatatttagctaaggttgggatctcgaattgaaaaatttgatcagatagaacatcatcaataacagttgaataattgagttttataaattatataaaatttgatatttgttaatataaaatatttattatgaattaagatcaatagtattcatgggatcttgagattgtaataaattttaatatcttacatgatctctaggatgttactctaaggtttatgggcccacatcatgtagccgacctgggtgctgggtttggaatgtgacaattatttatctcttgtgccagcatagtttgttcagcactttaattagtttggctcttctaatacaaaacctcctagattaagttcatctatatcagaaattgagtaccacatgccataccttctatcattcaaatctctctctctctttttctcctaattttcactggaaaagaggctgaagtttgttgttcaaatcgtgatgataaataatcgattccatagtttctgtttgcaaaagcaaggtctcataattcatgaatggttggagtttcttttactcaacaaattggttgacagagttgcacaaggaccacattcaattcttaaaacaaaagcacacgacagaaaaaggcgagaggaaggaacaaagcacttccaccttaaaaatattttctagctttatacatctctttagcccccattcagtgtaatgggtcttcgttgcgacaaagttttcgaacatagcttacatggagcatggcaaatgaaacaacacaaaaaagctcaagatatctcatttctatatggctgtacatcttaaaccagactactattcccttttgtgttccctgttgctgttaaaactaacctccaagacaaaaatggagtcggtggcggatgctaacatttatcagctcttgtgatcttcagtctcttgacagtggtcaagaacatcctgctcaaaccaaaggtaagaaactaattaggagagaggaagaaacgagcaatggcagatagaatgatagatggaagaataaagctggtaggaatcatatcatactcccatgggacatcccccaccatcatccagtctccttccttgtcttcataggtcagcacatgatccttactggtaggcacttgggcaatatcagggcctgatcaagtgatcgaaacaacgatgatggtaattctaaggctaattaagatgtatatatgcaatgaacaatttgatgctacaaaataatacaagttgcttgtgtcggtgcttacgcataatggaggtcctaaacatgcggcgaagtgtctttattaggccatcatagccatcaagtgcgaacagatccaatttcctgccaattggaatcccctccatgtaaaccttgacaaagaatgtagctgattgcctctgaatctgatgtcctttttctgccagtgtgctcctaagaagcggtttgatcggtggccaatcagatagttggtccctaatgaccaacaaatagagaaggaaaaagaaaaagaacaggaaattgaatcaggatgaaagctaatctatagataattagccgagagtccatggaacgtaggacttgagtaaactatccaaggtggttaatagaagggaaataaatgaggaaagagtagcaaaaagcgactctaaattgagacgaggatgggaaattttatggatggtatgaattaaaaagcaaggcaaggaatgaaaaagaaagaaaaaaaaatcaactagaattcacatttgagtgctaaaaataagaaaaaatttaaggaaaaaaaactatggagcaaatgatggagcaggagatcatcaatgagataatttggttcttgtatctcaaaaaagaaaagatgaacttggaaacgaaacatggatatatacatagagaagtacatgattccatttctgattaatttggtaggcaatagagaaaggccatataaagattaaatgaagtttgattataggaaaggcctttagttctaatattgaaacggaaaagaagaaagaaaacatacatgcatactttttttaaatgtgtgaactgataaaaaaaaggaagagggagacaggaagaaaaagaacagtatatgaaaagaagcaatcggcgtagggttctttaagagtgctgtaccttgcactggaagaactatcctgcagagaggaggctgacaggctaagtcctagccttagatctgtgctcaagtctctccttggctgagagagagaagatgcagtggagagagcagggtggctgctgctgtcgatggatgaagaaggcgaaccgttgtttcctcctcccattgcaaccagagagagagagagagagggagatgccaccctcgcttgtttgttgtagaagataggagtgagaaagagaggacaacgattgatatggagacagacaagagggtggcagaagaatgtggaataagagcttccttgcaactgactattaggtgtatgagtacttctgggggtccatcgtattggttgcacttcgaatacgtggcagaacagaagggataggcctagagcaagcttggccaatggggtgttggggtgacaccttgttaggctattggttggacttggccctctccacaattgtccccaactttatatattctatcaattagagaaaccatgaatactcacactttacactatcatgccgagcagtgtatggacacttgaataaactataggtgatacattctacttgttaataaaagccttccatatcaatgaacatgttgggtggttatgggggtatattaaaattatagaccatagaggggatgtgcccacactatcaaatctttgcgagggcaactttcccaccatttttttttttttttttgtcgatataaatacaatgaatccagtcattcttatttgtttgttcgtacttagcaatttcggggagagggaaagatgtgtgggacttgaactattttacttttggttgcactcacttaatttacttggatggtaacttacacacaacacttccaccagtggaaaagaattgaatatttagaagtctcccttatcgagatcaattaatgcttcttagctatttaggtacatcaaccaacttcatatgtactctttgattgctaacttctatcatctagttcttttttactcaattacgtgtgatattgtacatttcatggtatggctaattgacaaccaagtctagcctagcttaccaaaggatgggataaattgccatggttaagcgatggaatcatccatctctgcaataattctccagcatggtagctgcaattgctcaaaactagaacacagggtcgatatctgaaagagaaattgaaatggactcaatcgactagcctacggacacgacaattggcacatttggcaaggctgtagaggattgctgtgaccggcaagacttggctgcttcaagaactgaccggcttttttcagcaaatccttagtcgagcattaaacagatggttacaggacctgcgaccatgacaattcaaccactgaccttccatttaatctatgcttttcatgggacacacaatttgatcagtcaaagccacatgttttcccaattttgagactagctcaaaagacccaacaatcaaacaagattgtcacacaagacagtggtaggaaaagtaaatttctatccagtgggcagacaaaccaccatcttctttcttgtttggtttctcccttttcctttgacatcacatgcaagaagaaaagggatccttctcattgtttacacttttcttaacagaagaagacctataatacttactacatccatatatatttattacagattgcgtattcgcctttgaacagctcctacataagctgatgagctcctagaattgtcgacgatatttgttgtgccaaaaatacggcaagaaacgcattgaccgatttatgcaaacaagcaagtagccgtatgaacatggtggttgaggaaaaaaatgacaaagttttcggattctgatagtgagaagacaagtttttggattctgatggtgagacaagttgcttgatttgttcacgtgctaacaagatcacatgcttgtattggtgttactccgaattaatgtaggtttcttccggaatcaataacatagtatggtaagaatggaattagataaagtcgataacaatgttaaattaggtggctaaatcaacatggatctccggttgctgattatctcaaaataaagtaatggtaggaggggaggggcaagaaaaaggcttaaggaagaagctgttgaggaacaaaggtgcattctttatggagacagtgaactttagaaacaacgaggcactgtgatatattatcttattgacgggggaaagagacaaggtgtgcatggggttcgaagtttggaataaaaaagttgggagacttagaggctttcatttggtaaaaggttagattgtttaaagaagtgcacgatcctcgcaaaagaaagacatgagagctacttcaaggagacatgcaatcaactatatctccagacactagaagaaaaaagaaaacagggaaaaagccaaccgacccttggaccaaccaacaaccctttctttctctctctctctctctctctatctctcacagtattccaattgtcgcagtaggcataacctaactaaaaatttaactttagtcggtgctagttaattagtataaactgtaatctgttatttttggttggaagcaagttgaaactgccatgaaggtttctctgcttgaaggttgatgtcattgtttaaaggctgagcgtagtgtgttccttttgcaaaggaaattttattttattttttgctgacaagaatcctaatgagttgaagttactcctcctttgtggagagacggatgaaattagacctgcaacgttttccattcagggatccccaaaccactacaagtccaaagtgtgtgtgggagtcaagaggagaaaaatgtgttaaagatcgaggactagatgcaatttcgacgatttccttttctctagtaaaggaagggaacacctggcatatcttgttcctaaagaaatggcaaattgaaggatggtgcagtaacaaggggaaaaaaaggggggtgggttgttcccccgtatgttgcttccattgaggcctctttctcttggtccgatgtcctccattggtacatgcactttgtgtgcacctcaagcatgtattccgtggactccttggatctctacaagctctttctttcctttccatctcccataatgtcaatatcaatcaatcaaagcctctcgattgatcaatcaaaaacaagtaaggttgtcaggtggccttcaagaaaatcattaatgggtagaaattatcaaaaactggggagcttttccggagaaattatctctctacctatggattttaacttggagacctttttggagattgtgagtacaatgtatgcgaactccaagtcagcatgaggacacgagggagggggatgtcggatgaatgcggttggcatgagaggaatggccttgtatgatgtgcactagagtcctagtccccatgggccactttccctacatctcatcacattgcctccataatcccatacattggattctttatttcatctttccagccctttgcaagcccaatagaaaggggcaaggacaagcaagcagccccctgcactcaaacccacttttcttcccttccaagctgttaattcctagtcaagtctctcatcataatgatgatgtccaacctcccctccctcggtccttttcacccctcccacccctcttaagctttgatttcaccagtcgagactaaaggattggatcggagttccccagagagacaactttccccatggtggggcctctcttggatcccacttcctggcatctgctttcgcggactctgttggcatatccccttgagaatgtctgggtgatgtttttcctgcactggacttctagaaaaagtgcatgtagtttgattaaaataataatgacaatggaggtgtggttctgctacgagttccatcctcacacgcaagacctccgacccacttggtgataccaatgtgaccgtgttcttctaacttgagaaaaaaaaaaagttaaccatgaagttggggtgctggtggcaaggccagtcacgttcatacattatgcatcgttcgcagttcttggtccagactttgccaaatcacactcgatatcaatcctaacaatatgatctaagattaactttgccaaatcacactcaatatcaatctgttctagtacccgagggaaaaagatatctagttagaggatggactcatggttactagtttaatttcatgggcatacgcatgtggaagtccaaaattaatttagtgtcatgataacaaatgtttggatttcgtactttaataaaagtcgggtggctttttagcttccctattcctccaaaaaaaaaaaaacacatagttgctaagtcaatgtgaaggcaaaattgtagacaaaaagctttactttatcaatttgatacttacataggttgaagcactaacacagggttgtcggtattgcttttaagagttttatcttgggttgtatgtgctcctcttcccttgccatcctagtcaatggtactccgatgattttctttcactccacaatcggatttccccaagattatcctctttctccttatatttttgttctctatgctgatgccctctctcgtgttctccatactgcaatccaaagtcaagaccttgatacatatactcttcctttatgggcccaactaatatcctcacttactcttgacaaatgactatttcttgctaggttgggcgatggtataggaagccatgatcttcatgagaattctaagggattattgtactgtctctgagcaaaaagtgaacccactaaagttggttatctactttagcctaaagattaaacctcatcgaaggcagacgatcagggagtatttgggcatgggagtaggtcaaagtgtggcactacgtaggggtcccgatcatgggtcagagattgtggagatcaaagtatattaagatgaagtaaagcattagggagaggatggagggctggcaagtcaagtcgctatctatgatgggtcaagtgatgttggtccaatcagcctatgctctatgccaattgtgatggcccagcccatataacaaactcagcccaccaaatatgagaaatatgatataaataataaaatatgagaaagagagtttctctctctttcctctctctcttcagcctgaactagtattttctctctctaaaattgaactttctctctctattttctctctctaaaattctctctctagattatttctttctcctaagatttttagaattttgagaagaatgatgatgaatttaaatgattctcatgatgaatttttgatctgtgatcgtcggacggtacaccgacatccactttgatcagatcagatatttttagattttatttatcatgattttattgaattgttcacgtgataatcttaacatgatttgatctgatcgatcgaatttgttgaatcatattatctaaagaattcaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcccagccaaagggaactgggacttttctttggtaggtaggtaaggattggtatcgctcatcgccagaaatgcttggaccgcaagggatggtgacgattgatttgcttgtttgctgttggttttaaatggccggtgacaactcccaccaccctctcccctccatgattcctttaatcaatgcctaatctttgggccaggcccagttctgaagtaggaggactcgaggctgcttccaccacgctgttcgaagtcccacaccacagtgccttcggtcccacacgcaaccatgtctccattggatgcatgaattggtgatgaggcaaatcattatccttggtgtccagtagtgctgtggaacagagacttccacagctggccatctctctaccgcctctcttctggtcattggaactaaagattcttgaggaaaatggcgagtccggagtgcatgaccacatgatctccaagacctgtagcatgtaactcggcatgtcgataaatggctgatggacggccatgaatggagattcctctcaccaagacttctctctaggacaaacaacctaaggacatttcacgtcataaagttggaagaagataaaaagggagctggtccacctatgcactcctgtcttctctcagttctatgatatctgggggacatatatacatgcatcaggatgacatgatgtcatgtgaagtgcaaatgctatcttcatttcagtcactgtttctatttgtcttgctttaaggcctccatgctctctgggcctcaaacatatctctccccgaacttccatccagacagccttttcctttctcttatcctcaggaccatccaacacttaaagactaaaaagtggttttcaggtcacttgttctctcctttccttgcacaagtatgataggacaaaacaatttggagggatagagtagcttattttccctaatgaaagcgttttagctggaacatttgttacagcatcatgcaacatgtgctgtaaggagtagcctttgtggttggactccctccttctgaacaggggtgttccacaatcaaatctgagtgacatttgattggttaatgttgacatagattgatatgatgattcaatcattctttgaatctagtttagatgcaatttattttggtatagatttgtatctgctaaataaccagtccataacgcaaaggaaacacaagaagaaagaaagaaacagaactgttttaagtccacaaagttgcttcatttttcatcttttatctattggcaagcctgattgctaaccctacaaagcgatcgaaagagttagccgctgaggatcagattggtataacaaacgccaaggaccagaagaatacaaaaagcccgaatctttaaggcatgtattgacttaagggcgacgcgtcttgagcccttccattttacttgggcggtgcctcttgtttgaggtgtatcgcgagtccctctctaaatattatatatccagctccatacccaaagaaacaaaccatagtgccacgtatacagcttactgatccttccaacaatctagccttttttaggaattaaaagctacttaaactattcaatcaaaaaaaaaaaggaaaaagaaaaagaaaagaaaaagctacttgaactatatgattatattaatgcaagtcaatctctttctttaatctaataatgatagtagtacaagttgacacttcatagcagatgctagggataaaggatctcacaacaagaatatatttaatatatttaatctctccagggtagctttcattttaatatggccagaagatcttatctcttgtccaagaaactcgctggcattagcagtgccagcaagcaatccgggccacgggatggaaacctttgattaatcccccagccagtcaattcaatagaatgaaacgggaaaccaagtgcagcatgtcttaggcatagttgatagtcttctaagccatatagccgctttatcgccaaaaaaaaggccatataactgctttatcctcccctgctgccagactttggccaccttcttcgggaggctttggatcaaacgctccgttggaaatggcgctcggggatttcaataaagaaaagtctttggggatttcaataaagataagttttaagtttttgctgcagttgagcgtactctgaacgccacttggttcaaatccaaaagatttttgctggaagaagctgtctgaagccacaggagatggcttcatggaagttcgtttctctttattcgaatctttttgcaatttgtgggcgcctatggtgatagttgttggagttgttccgcaaattgagctgccttgattggttgtatcaggtgttaatgaacgatttttttttttttttgaggaacaagtatctaggagtcagaaaaattttttgtttgggtttctgttaccgcttgtttgaattctcaaaagcttccaagttttggttccgactggttttgatttcgtttcttaatcttagctaggagattggtcactaaaatgatactggatttcacttggttggtggttggaatggacaaggagcaattttgttgcaaaatggctcaaatatagaattataaaattccgtgctttggagaaaaaaggaaaaaaacgatgacttttatcagtctctgttcttcaaggtgtgactagaatgcgatcttatagataattctgagaagtgggtctaaaaattttcgcatcaaagttttaagcctcttctttatggtccccccttagctcaagtgtccatctgagtgtgtcgtcttgttcaatccatcatgccgctctctgagttccatcagacaagaaaagttgatactagccaatccaagatgaccaattgctcatctgatctgccttcttttatgtaagcatgctcgccttatatattacctggtaaatagtgaagctttttcatttactttttgttggatgagtgttcctggtttcattctgttgatgtatgctgatcttttctgattttgatccatggctgttgaacaaaggcccgacagtgaattcgtcgaactgctgtgggagaatggtcagatcgtgatgcatggccagtccaacaggcctaggaagagcttcttctccaccaccttctctagagctcaggagaaggatagcagagatgccgttatctcgaagaccggacagatcgaagctatggatccattggtgaatgatttctctcccaccgaggcctcgggtaatgcaggtttgaatgctcaggatgatgataccgtcccctggattaattactcgatcgaggattctcttcaaaacgattactgccaagattacatgctggaattcccaggggcgagcctgaattctgtgtctactcataccgaaaccgtgctcgcggatagaagccatggtttcactcagacttccgcaaagagttcacgtaacgtggaacatgggcgcacttgtgaacaacttgcaggaggctcggatcctagccggattaagtgcagccagttgtttcagttgtcgccggaacggcggagttcggccccgagtatgaagtcgagggcgacagagttgagcaccagagcaaccagtagtacgcaccatggtctggctgggtatttgctgagctcgaggctggaaaagcaaggtcttgctagttctacgttgtcacagtcaagcggtagcattggtttgacgaacttctctcatttctccggacctgctgcactggccaaagccaacctcctgagtctcgataggttgagaaacaatgagaaagcttccaccaccaccagtagcaacccgatggagtccaccagtggtttcttagcaactccagggttggcttcagcggcacccaaagtagagcggagatcaactacaaagcctcaacaggaaagggtctcggtcgagaagccagatgccgatcatgacggcaatgtgcataacaataatagcatagtgcccgactgcgttaagcgtcagctctcaggaaggaatgagaccgaaaagggtcctgaagcagctgtagcatcttcttctgtgtgttcgggcaacggtgctggggcagcatctaatgatcctaaacacagagcgaaaaggaaaaattatgaaggagaagaatccggtaatcagagcgaagtaagtcaaaagaatcatggatgcgtactgaattcttctacttggattgttgtgcttagaatctgtttaaatttctatgtaggatcatgaggatgagtctatgggcctaaagaagtctgctactgtgcgaggcacaagcacaaagcgaagccgtgctgcagaagtgcataatttgtcagaaagagtgagtttggatgcaactaacctgcttgactcgaataatccttcttagtttggattcataacttaaatgaagaatgcctgatatctgaactaatgaacagaggcgaagggataggattaacgagaaaatgcgtgcacttcaagagctcatacccaactgcaataaggtacaatttttgtccatctaaatttagtgttcatgttttttaatgcagtggtgaattttgaaagaggttgcctgattgatttcgaataacacttttacaaggtggacaaggcttcaatgctcgacgaggccatcgagtatcttaaatctctccagcttcaagtccaggtgaatattttggccctttctccccattaaacatttttttttttctttttggttggctagattctcaatgtaatcctttgttttgaaaattttcagttcttgacgcagatcatgtcaatgggaagtgggtcatgcatgctccccttgattccaccggctggtattcaacagcacatgcgcatgcctcccatggcacatttatcacagatgggtgtaggcatgggaatgggcatgagattaggttatggtatggggatgctagacatgaatggttctgcaagttgccctctacttccgcttcctcccatgcatggaccacagtttcctttcccctcaattcctggaacccagggtctgcatgggatgcccggttccaccggtcttccaatgtttggaattccggggcaggggcttccggcatcaatgcctcacattccaccacttggttctccgtcaggcctttctgccacaccggactcgatgcctggctcagcagggatgactaataatccattaccagtaacagatacatctccctcatcaacttccaaggatcaacatcaccgaagcctagacttgaaaaaaatacagaaaacaagaaccgacgacgcgcagattaagaattctactcaggttaaatcatttttcctgacccataagtactccccgtcgcatgatatcctacttcagatgatcagaaaaagactaaagttcttctgggtatttctgttcatttttctgtattctgtttgatgctctctctgtcttaacatactggtttttttaaccaccaggaagcaaaagaatcagtcaaaaagtctgccttggtgcaaatgagtaatcagacattgcatgctaccgggaatggagtccaggccaaaaagggagtccacccaccagcacaactggtgagtgggacacatgacatggttggacgatcgattcatgctgaaattgggttgtattctgaaaggacttgtacttatgcaggcgacggttgattcatttcaggcactggctgattgagaaaggccttgcataatttggcagaagccatccacttgacacataagatccttagaactttcaagtagccatccgttctcccagagctttccgggcagcattcatggtctgccctttgtatatcgagagtagcgggatcctccgtgcagtttctgtaaattggagagaagatgaggtttcagggagtgtagaaagaaaggtgtgttgtgcacctctgtaattaagcatttctattcgttaatgtagcagtggctccttctagcatgattcttgttcaagttggaagaccttttgcttgtgatagatttgttctgacatgcattatttactgttttgggcctccattgcgtgccatctcttcatactatagtcaaaaagtattgcccagctactttcatagattagtagctaatgaaacagcaactgcgtaccataacgtgattgcagcatcgaaacagtcaactcgacaagaaatccgttaaagcttatcctattgcaaatcagcaagttaacacgctaattctcgttcggaatagcttgtaaccggtgactggtacgttgggccacaacaagattcatccccttctagggtggctgttggttggaattagatgataaaccgatattgaagcgggaccaataatagagcagaccccgaatggataggataaagacttgttttttttttttttttttgggtacaggataaagactgtttttgatgtatacatgtatggtcttcatcaagcttcaattccttttcggaatattcagaatgctaatgctagacattggagaaatcactgaatgattccatccgaaatgactttccttttctaattttggcaacttcgtggcttgtcatatcatcccatccaagtttttttttattattattttatttttttttaaggtggagaacaattacctaaataaatgcatgccaactcatggaaagcacctccgttatctctttctgcttcctctatttctccatcctccgtacattctttaattcaattcattgggggaagtatcttactttattccttccctcaaaaaggaatctactatgtgcatgcatctctgtaaagatagttgcagttcggtctcgtcaacaatactagtcttgtcaccaaactgtttcacatttaactttctccaatcatgtttctcactgaattggtgtattctcactcacgaacacttaataaaggctaacagtacctacttctgtcagcatgtctctgatcgtttgtcttcttttcagacacaagtaattgtcttcttttcaaaacacaagtaattgacccttaaaaacagagccaagagctttgtgggccagtattctccagatgtgatgcaagattggcatatggaaaagaatatctcatccacatttttttaaacatactaggagattggtcgagtgcataaataaaatctattttgagatgagatataaaataaaatcttataaacaagaaagaaggtcatatcgagttacaaagtttaacatttcatttgtgatcaagaggctgcaacgccaatttcatttcccaagtgatcagcaaccttctggcttcctgaagatctcaaaggcaggcacaactagtgtagcaatattaaaagaaaaaaaaaggtcaaagtcttcaaatctgtaggcactcctgatggtttgtaaagattctcttctcatatatccttcaatatcttaggagagattggcatcatcctgctgctagcagagctagggggaaaactcaaacagaatggtctgaatcatctctaggagcattttataggccaaactgcccggggttaacagaagttagatagcccctaattgttcatttgttacagaatcttccacatttagccattcatttttgttaggccatcacatctcaagcatactaacaggtgacttgcaacacattaaaacaaacaaatggaggatactaaaggctccttcaacaattgtttccccttctccaatataattttgtagaaccttaaatagtttgggttgaatttgggggcaaaccacttttgcagttggatggagcattgtatatactcttctctcacaatcaaggccaataagatctaggatatctacccaggagacaatcatattcaatgcccatgtgattgacattagcaatcatgcaaatgtctctatatctctatggtagctggcagagacaatctaaggagaggtgagcatttgagaacccaaagtttgaatatcgtcaatcattcagacaaacagattacctaaatcaaccaggatagcaatgaaatttggcacttaagagaagtcttgttattgtttcaatcttcactctcatgtctttagcttgacttcttctggtaacacaggtttttgccagctgtagtactaataatagatgtttcttggtttcatatgtttttcaattctccagaaaggtttggatgacatatcatggctgcttaaaatcatgcatgcattaccctgcacagtgctaataatttctagatcttaccacttcattttgaggcaacaaattgatcatcataccgcatattactctaaagcagcttcagcagcatgaattttgccttctccctgaagtcatccagaaataagctgtatcacgctaagatgaagagtaacggctcattgaatgctccagccatgaggcaggcttgtgtcttataggaatttcctaatgaactgtatagggcactgtccaatctctctctctctctctctctcacacacacacacacacacacacacacacaaaaagaaataaatgaaaaaactgtgctagtcgagtacgtccatgacaacaagcagaagatctttcctcaagggattacaccaatggctggtttttaactgtaacaaaaataaaggatacatgacaggaatgtagtttgatagtgaagtcttccagttcgtcctcttgtaagtagaattgaacaaaatctagtaggcactaaacagaaccggagctgtaagaagagaatattgacatatatgaattaaaataaaaagagaacacatacatacgtagaagttcaaaagaaactggtgcaataaaactcccacggaaaactttgcctttgtagccaaaaagacttctaagacaaattttagatgctttagacattcttacatatattgatcggtatgatatataagtgaaatgattcattaaaaagaatatgactttacaacaacttgagacaggagattcaattcaaagagatcttcaggataagtaggaactggatatgatgcttgagactctaaataaatgagtcagacatgtccctacaagactccatggagtccctgcactgcgcaaacaataaatcccatttgctacaatcaccctgctcatctaagatcaatcaggtttcaccatggttaggtttaatcatggttcctttcttgataagaccaaaacagtttgccgctgcacatgttaagcatcgtggttgaagcaccgcagatcaaaccaagaatgaacaagcaatatgaagcttgtatcctgtatctgattgaaaagaaacagaaacagaagatatctgctataattggcccttcccttaatccacataagtgaaatcatcctctgctaaattatgagggaagctcatgtcaggaacataaccttcctccctcatctctaaaagtaggatgccaataatgtcataaatctgatcaaattctgcaagtgaccgatctctagcaagaaatggatgaatagaagatccaatctgaatccagctactgcctggtttcttcatcaaacccctgtcttttaccattgttcttacattcattacatctgcccatctcccagcagcagcatatatattagacagcagaatatagtaccctggatcttcaggcttcctttcaaaaatctgtttactaacaagctcagcaaggtctagtcttttataaactctacaagctcccagaaggcttcccaatacatcaatatctggtttcactggcatctttctgataaactcccatgcctcatccaggtacccagatctgctgtaaaggtccaccatgcatgagtagtgctccatttctggaagaataccatagtcttctatcatggaattgtagtagtgcaagcctcttctgagaagaccagcatggctgcaagctgaaagcagcgctataaatgtaactttatctggcacaattctctctccctccatatggctgaagaatgaaaatgcctcaataccatgaccatgcattccaaatgcagcaattatagtgttataagtaacaatatccctttttgtcatctgctcaaaaaccttcttcccaaggtctagacacccacacttgcagtacatatctatcagcgaattattcacagaaatcatgcaatccagactggctctagtcacgtaaccatgcagttcctttccttggttgagcatagtgaagcgattgcacaaaggaagaacagtcaccatggtcacagaatttggatgtaatcctgattcccggatccttcgcaatgtttggaaggcaaaatccacatttccattcgtggcatatcctgctagtattgagttccctattgcgatatctctatccgacatgatttcaaaaatgaactccgcttctctcatcgacccactttggcaataaagatcaaccagtgcactcgcaataaatacatcaaactcaaaaccatgtctaatggcatagccatggatctcttttccttgcttgagcagcttcccttctgaaaaactaggaagaacactagctatagtgaccgaactgggtcttacacctgaccccatcatctcaatgaacaaatccacactctcactatattcacagttctgggaataccctgcgattaagctactccaagagactacgtcattgtattccatagaacggaacagatgatgagctaatggagtatatccacatttacagtacatgtctatcaaagcatttgaaacacagagatcatcaccaaatccacttctgatggcacagccatgcaaccccattcccacatgcaaagctcctaacctaccgcatgccggaagaacagtcgctacgatcaccgaatcggtctgtataccttccaacctcatacttctaaacagattcaaggcctccaaccaatctccatgatgcatagttccacagatcatcgctccccacgagaccacatctctcatcggcatatcgtcaaatactctccgagcttctcttaagctgccacactttgcaaacatgtctatgagggcgcatcgcacataaagattggattttgaatcgcaatgaacgctgttggattcgatcgattcctggacctgtctgccctgctcgagagccgataattctgaacatgccttcagaacgagcgggtaagtgaaattatcggccggcaggccttcagtcgtcatcttgcgataaaacgccaatacctcagagaaccgacccgcattgacaaagcctttgaggatcgagttccaggcaaaggagtttcttttcggcagttggtggaagacaagcagggcttcatcaaagcagtcaaggctgacatagatgttgacaagttgcgagcctaacacgaggctgggtttctggtggagatagccgtgaactagtatgaggccatgcagctttctagcttcatggggactggtcgttgatctcaggtgaaggaagagggtacggtgggagaaggaagacggttttggcagatgagattcctggtactggctcgtgggagatggacttggaggcgaatttgcgatggaattcgaatgtggcgaaggcggaagtctgggtctggttctgggtggcgctgagaattggtaaaggccaaggcatgtggtgatggtttctctcggtttcatggcagcagtttggaattaccgttgggcatggctattgacttccaatttgtcagagtgtcgcttgcccccaaaaaaaaaaaaaaattctaatgttgcactgcaatggtagagagcttccggaacaaatggtggctctgtacctcacacccacacacatacattaaaaagaaaaaaaagaaaaaatcatggtggctaatattgtattctttgtggttgcagaagcattttataaaattcttattttttaatctgtgttatttttttaaaatttttctgaacttgttaccaaagaaaaattctgaacttgaaaaaaatgaagaactccatcttttttaattatggtgatcacaacataagaacacaggatggtggtaagcggtaactactctgactttgccaccttacgataggcactttttcttctttttttttttttccatttgcatatatccgtttgcttcttctctgcggtgagtttggaccctctccggtcggcgtttggactggaaagagtctatttattcggactggacagaggctctccatatcatataaatttaaattgtggagaacttagaccaagcattacccatcgcactatatataaatagccccagtagattctaattactctcgcatttgcgccttcgttatccactctatgttagtgccgctaatggcagtagctataattattaaaacacatcgtgttggcctatgtctgttttccttgcagctacatagatttaacaaaatcctaaatgtcaatcaccgtatacgaggaataaacccctaaaaactaaaggtggtggagggaccggaccaagaataatctccagttggcaacggtgagaattctgtgaaggcagtccatagcaaccaaactgtaacaaccaacatcaacatcctagcctataatcatcagtgcttaggtcagaaaagaaaagaaaacaaaaaaaaagaaaaaagaaaagatggtcttttccagcaggcttgtcaaaataccattttctggatactgttccatgcaggcacaaggctaaatctctgacatagtttagcaaatacaacttcctcagaaaattctaagcgggcatccagaagatagcatcgtcccatgtgaggttgcttaacaaggaggagaaactgcaaatcataagataaacactgcaatgaacccttttttacaatctctgcataacaatgtgttccctacaaaggcctgcaaatgatttgttcttctgtcaaacatattgcagacaaaatgatcagaagcccagtaggcacgaactaaacagcctcaagattgagagttgacagagttttgctcagggaatcaacagactcttgagccttcacttcctctgcaccttttgcaacaggttccaccacttgaggctgaggcatttcgtctgcaagttccatttccagcatcttaaactcttcttcgacatcttcaccatcaatatccatagactgaagtggcattgattctgcaagaaatgcaaaggaattaataccatatggaaaaactaggacatgcaagaaagccagatagacaggcccaatccaaagccagggctggcaagcctgacactgtaacaatcatatatagcttctacatgataccataaggaatgaaatgtgattcaaagtcatgatttttccaaacaaattatatgatttttatacaagtggctcaagcagagatgaagcacgttacccaaggcttcctcaacttgcttttgagcagcaacttgctcatcaagctcttgaagatggagatgaacttcttccacactgatcctgtgttccttgattgcttgagcacctatttggatagcctcagaaacctgatgtacaatgatgaaagaaattgaatttatgaatccaagttacaagaaaagagtagcagtcatgacagaaacttctcccacactaccttcttcgtcgattcagcatctgtaatgacaccaagaactacttccacccgttccaaaagtgatgtacatttagccctgctttctgataataacttggactgccgtatatgcctataagcagtttgtttattccctgctttaaaggaagctaatgccatttttcttgaactgcagcaacagcaatgtttcataaggatacaacattttcaaaggttctaaattccaaaggatgttaagcacaaatactgaaatcatggagacccaagtcttcaaagtttttcatcatactttattttaacatagtttcatattttggaatgaacaccttgggcaaatatggagctttgctatccatgaccagaaaagttaaattatacagcatgaataaattgtatttaatacaactgaataagaacaactgtgtattcattaggctgtgaatacacaactacacaggaaccatttatttgaaatatacccaacaactactccatatgccataatatcaaccatgagtctatgactaatatgctctaactcttaccatgcatgctatacagtaaagggctgcaggctgacatgttaaggacaaatacaaccatggcataaaatggacctcttagagaaaaaggatatgaaatttgcattcatatgatatgttcaacaccgaccagattacttgtgttgctagctctcctaaattatacttataaagcagtagacatacagtatatgtcaggcctgttggtttcccaatttctgccatgccactgtcaacaggcattcagaagatgataagaaggtgaaacttagaattgtaactttagcattgtaccagttcctgtctaaaatgctctagcttaggaattactatcaagttcataggacaattacatctcccaacggcgatcaatcacatcaagttgttgctgcaacttttctgttgtccaattcaagtgcaaagcatcatagtcaagccttgagatgctggaaacagatactggcacgagagacagtttgacaccctgaagacagcaactgaactaagtatttgtcctggcaaaaactgtaaaaatcaacataaatgtaatagaactaaaacagaccacaaaacaaatgcattgccatcaaaataacagacaaagatcaaaacagtctacctcaataaaatcttcctttctgatcgagaggtatcgtgccttcccacattcacacagaaaacttaagattgtggcagcttcatcagatcccttgcagatgctctggaacttcccgattgtaataacacaagcagaagtccaatggttctcatttaaaatcttaataatctcagcagctctttcctgcaatttgacatggacagaatctgccaaatgagttggctaaaagccgaaggaaggaaaactgtgaaaataagatttggtatgcacctgaagcaatggccttaagatgagaagatcttcaaagttatcttgtaaagccaatgatctggagatacctatcatgtgtcccactcttctaagcatctgatatagatgcccacttgttggatcaattagatcccctcttaataagatatcaccattgatatgcatttcatgctgacagaggtaaaagaaagatgagaaacaaagcagaaaacttcacattgacgctgaaagcagacatgaagatctcaagcatttattacaaggactgtgaccataacttacaaatcaacatttagaaaaagcaaaacactaccactgatgctactttatacgcatatatagatcacaaattgcatggaagaatttctggtttaattctaaaaataacctgaggattaaccaacatgcctcatccatctacttcagcttggctttaaatccttcattaccattcattttatccaccagctctctacctaacaccaaccctccactttcttcatctgattggtgttgtctatccagtgatcttcagcacacattaaatatatttatggatcacagctgagggtggaaataaaactagagaaaagagaagaagatagatgattaagaagaaactttcagaaagtctagggaagaacatagaaatgagagaaaaaagagcctggcccttaatattttcccaaaacagtatcttaaaacaccacagaaaacagcaaggctattactccttttgaggcttggtcagccacaaacaaattatgcttctaccaggactcttttgaaggaaatagtaattacagaactaccaactaatgctctcgtaaataagtaaactaactagccatgtaaattccctgactgagcccttttgggaccctataatcaatctagaaactttttagaatttagacacataaaacatgatcacatgcaatgttattaaggtgctcgtctaggcgcgcctaggtgctcaagcgaggcgcccttggctgaaagcacctcagcctcctccagacaagcgcctctaccgcctaagcgctcgcttggagcaaggcgcaaggctctcgcctttggcgcccaattaaaattgattttgttctcctggctgttcaatttctaatttaacagctgtaattcactttaatttgaaattacagctgtgggtaatagataaatcctttaaaagaataaaaaaaaggtacttaagtaatttattaaaagaaattaagaaacaaataggttttaaaaagagattaaaaagtcacaactacatgcaccctgtacggctataccccttcaacttccctggactttggacggctagagtagttcccttccctccattgaagttgacagcgcccaagcaaaaaaaaagatatgaattttgttctctttttcacccacttttcacaatttattttctcctctccctctcttaatctcctctccttcttctctatttgtttctattttttattcaataaaacaaagcatgtttgtatttgtcttcaataaaacagttcacaaagcaggtcaacagtgcattggttttacaatggcactatttattctctattcttcttctcttaatctccttctccttctcctttcctgttcgtgactgttttttattcaataaaatagagtatgtttgtattttttttttcaataaaacagttctctgttcatctctgactctctactttgtgcagtcagcagtgcactagttttacaatggcagcagcaaagggtacaacgaccaatgctagcagtaaaaaggaccctggttggaaatataatttcttgaaagatcctaaagatcccaattctgttacatgtatgttctattctaaggtgacaaaaggtgggatatatagggcaaaatagcttcaaatcggaaagtttaaaaatgctaaagcatgtctcaaatgccctgagaatgtgagagaagagctgctgaattacatatccaagagaaagaaccacaaagagaattatcataaagtgccagactttgatgattttgtcaacatgattgagattgaagatgatgacaatgaagctgaaaaccaaacttccagaaaaaggttagcatctggttcagccacgaataaagggatggataatgtcaagaagccatggcataaaggtccaatggattcctttgtgtatcagaagccagagaaagtggttcaacttcgaaagcaaggaaaattgaagcaaacaaacattcaagatgcatgtgacaagaagaaaaaaagaagaagcttgtcaatatattgcttgtctgttctaccaagctggaataccattcaatgttgcaaatttagacacatttaaacatgcagttgaagcaattgggcagtatggtcctaatttaaaacccccaagctaccatgagttaagagtttcactgcttaagaaagaattggcatacacagatgatttgttcaagagtcataaggaagcttgggtaaaacatggatgttctgtgatgtcagatggatggactaatcagagggatcgaagtttaatgaattttctggtgaactaccctgctggatcaatgttcgtaaaatctattgatgcttcatcatatgttacaactggagagaaaatgtttaggttgttagactcttttgtggaacatgtgggaaaggcaaatgttgtccaagtaattaccgataatgcaactaatttcatcatggctggtatgactttctaatcctgatttttaatgccaatattctagatttctagttgtacattgtgatgtataaaagactttctaattctaatttctaattctacattgcaaattgtttttgcatttgtttaaaataggaaagcttttacaagtaaagaggccacatatttattggacaccatgtgcagcacattgcatagatctaatgttggaagatattggggagattccacaagttaaacgaactattgatagaggagttgcacttaccggttttatttttacaaccacgttggtgctctaaacattatgagggagttcacaaaaaggagggacttagttagggctggaaaaatcatattttgcacattatatcttactttgcaaagcattcacaaacaaaaggttaacttgagaacaatgtttacttctcaaggatgggtgtccagcaaatgggtaaaagatcagaagggtaaacggatttcagaaactgttctctcccctattttttggaatggtgtgcatctggttgtgagcgtaattggagtgtgtttgaacaggttagttacttacatcatgtgctgcacatgcaaatcttattaaataatagtaatattatatttttaaacaaattttgataaatgattgattggtacttgcagattcatacaaagagaaggaataggctaaagcaaaagaagcttagtgatttagtgtacgtcaagtacaatcaaaagcttaaagagagatatgatcggtgcaatgttattgatcctatttctttgcaagaaattgatgattgtaatgagtggttgattggaaagtctggcatgcaaggagtcaattctatggatgttaaggatgatttggtgtttgttgatgatgatgacttgacatggggtgcagtagctagggcagcaagtgttagagaaggaaggaaaaatatcaaattgcaagcaagatcaagatcaacagcagcttcaacttcacattcaaagccaccaaacttaaatcatgaagagattcgttctagttcagaagaagagattgaggagaacgtagagaatgacctatctgatgatggaggagatgatcattaatgacaacttaggcataaaatctgatgaagacttttagttttagacttttagaatagaatagtaggctgccttgtgtaagtaatggagaaaacagaaaactcagaaaagttttagtcttttgggtatggtgtttagacaaaaaatcagatgaaaacttttagttttggattagatcattagaacaataggctgtaattaagacttagtttagaatagactatatttattttctatttttcctaaaaacatggcatctgacttcaatcaggttttcgctttttcagcgcctagtacctcaggcgccagactgggtttagcaccttgagggcgtctagcacccttaacaaccttgatcacatgggttcactgcaattctgaaatgtttaaatagcttatccatataagtgaaaaagcttgaacataatttggtttgaacataaacccatatagaaaatgaaaccttcaatgagggaacaatttaagcaatggtactttagtttgtatacaatataatcagtcacatatgtgcctgtgctgaaacaagcacacctgcacacacatgcacccacacacatgcgagaaaacagctcacaatatgggaacaatattaataaatttgtatttgtagcttgcatacatgcataacatccatgtgcatgcgtatgcatgcacacacccacaccaacacgtacacaaagagatatgagaaaagatatactgtattgaatttaaacgtaacagaaattaaaatgatgtattataactaaaataaatatgatgcaagaagaagctcaccaaaaccctatccatgcacaagggggtcagacctccacgagcaaaccaaacattcttgacctatagaaatataaatagaatacttttgagaaaacatgaataaaaagttaagcagtgataaagatttatatgtgcaaagtataaagttttaattttcacatattttcttgtcatgtttgcaacatcaataggatcaaaagcaatcaccaaggtgatgaaaactagggactagccccaacttaaatagatccatgattagacctcccatagcggtccaaacatttacttaagaagcagaccgggtccaatttctcgtacttgctcagtgtgataactttcatgaattgcactgccagttcagtggggctgttggcctaccatgcagttgcccgctgctcctgccacctatctggtaagcagagcaattgttatccttactgttctctctgcttggggccccctcctattgctctagtcatcagctatgacagctccagctcgcacccactacgtaaggccacagtgagcactgtggcctgcctcagaaattagggggtcatattgcaaagtttacaaccatatctcatgctgttatctaggagatgtatggctcataatttctttaagaaaaggtcaaatcataaatcccatcttgttaagaaaaatcatcatacagaatgctttgttcataaagcttgtcatcttctcccagtgttcccgacatggtgcatgcaacatgaaccaaaaggcaaaagtagtttaagtaaaaagaaaacacaatcaaaatgataatttttataaagcaatctcactaactgaatgtaaaacctaataaagacatctcattacatatttgggagtacaacacaaacattgaaaagagggcaaatattttcaatgtatcgcatgaccatgatttcaaattgtaggcaataggcactgtttgttggacatgcacaatgcattcatgcaatatcaatgatgtatgttgttacagtgacattttgtttgccaatcatgcatgttttttttggtcgcaaattatgcatgcttttcggtaatctaattttgttggcatgtagccgatactccaacataagccatcacagtactaagataccgcagtcaacaagacaattgaatatctaaaaacaataactcagtatatttctccaccagtgtatcaccagaagatagatagagttagccagttaaaattgaatttaaattattatggataaaatttttgcagtctaccaagcggcatccatagccactgcccaataacaaatcctctaacataagaatgaaactgcatggctggagtcatatctcacattgaaaaaccaataataagttcttcaccattttaagggtcaaggctttgtgtgggctatgattctaacagcagtcacagaaccgaactcctcttaccaactatcaaccaacaaaaacatagaacatagctgctacaatggtagccgatatattaaaaaacaaattgcttgttaatgaaatcaatcttctcgcagaaagcaacaccccaaataattccaaaaccccaaaactcctagtcagaaaaacctctaaataagtagaaccacaaatgcatccattgtgaatatttaaaaatcaaaacaagcacttctgaaatacaacttgcggaagagaacacatcaagaactatgtaattccagacaaatacctaaaataccaagtaataacaccgagttggatcgaaaccaacaccttgtacctaattgaattacattttaagcaaaattgtgattaaagttatcaatttgtagagagaagatagatataaaccccaaatgaaaaagatttgaggaattcgtaaagcactggcctcggaggatcggacgacgcagaggccgaggctacgagcgaccttgaggatgagatccctccagataaggaagcggtgctcccaatccgaccgctggccgctgaaggccttgaagcgcgcggccgacgccacctcgtcgtcccaatccggcacttctctcctcaccacttcctccaccgccgccgacgaaggaaagggaagaggaggagacgaactactcattcagatcaacccagagaaacctaggatttctaatcgcaggaaatggattgagagagagagacggggactcggggagggaacgagcgttccgcttaaccaattgacgccatcagaaaaattagtgcaatttagcacggtgggtcacaccgatttcaggaacatagctcgtataaggacaaatgagtcgggatttcctcttgatccaagattgaaccagaaggtgtaatctctcaatcatagctacgcattttaaaaccaaagggcctcgacttagaacaatcaaggggttagattaggacttgaccgaacttgacccaacccggtctccgaacttttgctacgagaaaagttggaaaccagcatgctctcatcccgccctccctgactcccctgcccttttcttcattgtttctaattaggtctgtcgatttgagttgggccgttaggttggcccgtcccaccatataaataaaatagattgagttcatattttaacaatccatttaaaaacaggtcaaataatccatcccatttgggttggcaaattgaaagaggtcggggcaggttgggacgagctggttcacctattttgtttagtaaaaaaaatattaccaaatctccttgaggctttgatccttatctagttatccacctattttgtttagtaaaaaattacaaaccctccaaagattgtggagaagatgggagaggagagaaaagagttaacagttttttttttttgaggggagaaattttggcgagttggctcatttaacccgcagaccatgacggatcggatcgggttggagtttttccaacccaccaattaaacggatcagcctgccctaccccgtttagaagtgggtcggggtggatcggtccgtcttgacagctctatctctaatatagaattagaaggttcatcagacctttcatggatcacttggacgaggtttggcaataagatctattacatccaaaacttaattataaaatgaaactcaaaaagccataacttatattttgaaaggatttggtaagcttgatgtacaaatcgaggactaacttctaataaaatctagaaatttttatgatatcttctatttttaaaaaatttagcctgaactataagagggatctatttcttaaaaaaatagatttcaatcgtataaatagagtttgtatcacaattttgtacataagaatgaaaataaaaaagattttatcctactttctgcctaatctctcttttaaatagaagagaaatccatcacaattataaaatcatggacctttctaatataaatagaacgtgtaacaaatttctctatctttaatgaaaataaatggcttaaaaccctgcttttaaaaaatatcttatttatttattattttgagagctctatattaagatggttgaaagaaattcttgctttgatcaagttcgtattagaattttagtccttaaatatacgaggcattagtctcgactcgagagtattacaagcaaataggaaaatcattatcaagtgtattaaagagtaaaagcaaatgtagccattgcttttgcctcatcaagtagcgatgtgaagaatgccttacacaattggatgagaagaccacctaactcactgttcttatatcttagttagcaataccttcaactcaagcactagttactcctattacatagttcttcgtttataaaaaagatgaataattgtcaagagaggaggataagcaacttataggtactcaaaatttccctcttcagctcttttaagttaaagcttgcaatgagatttgtgttcaactcttcgatataaagaatttcagtcttgtaactgaactgctagtttccttggtgacttttcacattccatgatatctagaaatttgctgacttcataatcaactccaaaagaaatatcacttgtcaggcttctaaaactgccatcagctctacagcttaaatgaaaatgtcacttggcaccaggtatgagagatgtgaatgatccttgatcttgactatcacctagaatgctaaaatacaactcgttaatataattttatatagcctaaggaactggaaattacaatctttacctaggaagagggatgtgtctcttgtgacttggagaaggtattgaaaataacaatattttccaaatcagggtgatatatctgagattcattacttggagttgaccaagccttccctcctgccacatagccttgcaggttttatggcaggccctccatttaagtgcgatgcattggctgtaatcccgcaacattttgaagattgatgttgagaggcaatactacaatgttcccaaactttggtggctcattttcccttttgctgacacataagaggtagataattataaggcctgtaggttaggatcatcgctattaaatagataaacttggatccagaacctgatgatacatatactcgcctgagatgggcatatttggtatctatattagactcaccatttacaccaaaaaaaaatagaaggaaaaagaaaactatatcaggccatggaggtgagacatgcctaaatgcctatgaaaaataaaaccactcgatcctcattcaccaaccacttcatgatcaaaaattaagttcctttcatattcccaggcataatcctagtccctgaattaactttttgtcctaaatatatccatatggcattaatggagggtgaagattgccttctaaacaaaaaaaaaaaaaaggaaaaagaaacctacaataatctaacagaaggttatcttcttctttgggtggtaaatagcccatttttctcctatactcgtagccattgggttgcatgtcattcttggacataggtcttacaaacagccagtcacctcggatgctgaaaaagcttctaccctaaaaaggacaagtttaagttttctctggtagaaaattattgagttttgatttaatggcggccatatgaccatggtttgcaaatgatctgaataagagcaaacaggtcaaaagttcttatttaagcggtaacaaggtgcagaatggcagcaacagcagaatcaaatttcgaagtctttctggtgccagtccgattcaaagagatagattaattaatctgcccgcatgacaaccttaatttgtcttgtttccctctctttttcctaagcctttagttttgcatatggcatctgaattaaataatcatcatgatttgaatgtcaaaatcacgctcctattttcttttcttttaaaggctaccatgtgctttctttttgaaggctagcaatgatgtacaagcacaacctttctaatgatgtagaataccaagtcttgcagtaaaaatgaacatgtatatatccacatgatgcacatgagaatggcatgaatgtagaaaacaatcatcaagtccactgatgtaacctaactgaaaaatgaaagaaaattcagctgccattaaaaatatgtatctatgataactcaagcaacatgcttactatagtagggtaaaacagacatttgcctgctcaaaaattcatcacctaaacattatgagaaataaaattatttagtacattatccatatagccctatttcaaaggtagagtagagcaagacttcaaagagcaactagcaaaaacatattttaagttacaaactataagtagaatcacacacatcacatgatcaaccaaaagaattctatacatacaggcaaaaatatcacaaggcaaatacaagcatacatactgaaagaaaaataacaacaatacaaagagatattccattttatatcttcacaggtatcgagcaaagaccaagacctcttgtgaatccttccctgcatgtgacttggttgctgaagtagaaatcctcttgaattgccatctaatcttctatatacacatgcactagttacactgcactttcttctgcagaaacattggcataggcaggatgccaacatatgcaaggatgagctttatagcatagaaaaacaaatatattaaaatcttatattaaaagccaatctgcatctacacctcctctccgctctattttttttcaactgttgaaatgagctgtagatctctgtaattgggaatgtaatcttcctaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcctctatctcttcttccgtctctgtttttcaacattaactcatcttttcctttagatgacattggtctttgaactgggtgatttcccaacaattgccttcttcactttaacaattgacagcttcacctttgatattatgttatttgactggcgttgagatgtcttatctataaccttttgttcaggagcctttacatctgtccttgtatcaccaccttctttggtgggttcaactgaactttgatcatcagccttcacaatctcttccttgttgtctgctgaaccttcggtcttaatggtctgcatggcttttgctggcttcaattctgacttggcctccttagagtcatgttctagttctctaacagatgcattaacattgctttcccctccaaccacatcaaggtccctggaggtctctatgaaagttgcatcgtccccctaaaaactttcatcttttttctccttgaccacctcaacatctcctaaagccttttcttgcctagagacttcaacaacttcagcagcatcatatcttctggttttctcacttaaagttggctttttgaactcagtcttttctggcttctcttcttcaaccttagcttcgggcttcccagcctgttcagcaacttgagtagctgaggtggtatgaatagcctcaaccttaattgcagtagaaccaccttctccatccataaattcctccatacctgcatcagcattgggatcaaaatctctcttttctattacatcaggaactaaagctcctacctgaacttccttaagctcattaacttccacactggggattataatggcatcaggtgtagactccaatacagtaaatgttgttgaaggtcccactgatgttgaacttggtgcagcagaaactactggagcttcttccttactttcaatttcttcaactgttggctcttttattgcttcaggttctttttcttgcattttagatgcctctgtatcctctgctggtttttctacagcctcagttggtggctcagaagtatcagttgcattaacttggttctctacttcaacctcaactgatggtgttgcagtagacttatcatcttcttctgtttttacttgttcagccacggtgacattttctttatctcctggccttttatctgattctgttatagatgcttcaacattttgtgaaccctccactttgatcttttctcccttacgtgtttctttaacatccttggatttagaaacattcatttcatgaacattttttatatcatcatctgctttcatcgaatcaatatgctgcggaagttttaagccagttagcaaacaaccaaaacctcacacacacacacacccccaaagagaaagaacattaggtccacaattatcaacccaattcatattataatctgtctagtaaattagtaaagtttgcttctaaaataccattaaacttaattaataaaaaaataataaatttgaccaacagctgttagctcaactggtaggtacacatatctcgaagttgagtggtggcaaaataaccataatcatttcagatacaatattatttccactctttatataaattcacctaaagacaaaaaacatcttttttcactgttaatatacaaaacactcgtcctactgcctcactgcagatcccaagtagcttatcattcacatattgtataaaaattttatcctgaaaaattgaaatcttttcatagatgtattagagcttctgctttctaataatacagtcaccaccacgagctagtattaatagaagtattaaattctaaaaatgtttaagacaacaaaatcatattttgcttccttgtccagtccactgcaactagatgaaatacagcaattttcccggctgatttaaagcatgctgtcattagttcaacttcaaagatttgcaaaaaaagtatctgaattttaaggttttctgaagtcttaacatgactttggaagaaagtatattagatgttgggctacttctgcatgaaagttcttcgatcaacaaaaggaagaaatgagttcgagcaggcatatgcccatcctatttccttgaaaaggaaaaggaaaaggaaagaaaagaaacaagaaaagaagacgcataagtggtaataaatcattattatgagtggcagaactttacaaaaacgagttctaagaaagaaaagaagttcaaaacaaaatactaagaaattaagacattaatatggtaaggcactaaagctagactagcttagaatagatgcatttgatatgaagtgaagttgaatcttgggaaagagggcctttcacaatatccctcttcatgctaataaaaataactattccttttgtttcatattcttctttctttgttccaaactctgagctatattggatacttgttttgttattcgctgtatgttcccaagggaacttggtctctgtttgtttcacatacgctaaaacaaaatagggtcaatctgccaacttttttgctcaaaaataaatattccaaaagataatcaggttagacatgtgaaatatctttttcatgattcactagcctatccactacaaagatgcaaagacaagttgctgtcagccaacaaaaaaggaataagaaaggcaaaatataagaaggcaaaaaaaaaaaaagaatcagagattgcactttagagttagcataatgaaaatctccataggttagacatgacagattaaagcaaaaatatgtgagactagttttatcagatattgtcgccagggtcaaagcataaagaagataaataaaaaataataataaaaataaatacaagagacatcactgagactattagaggcttgagtccatcatacgacacaactgcagcctgctggctgctactctgaatagcaataacaagggggggaattttgaagccaacctaagagtgtcgtgccttagatcattaacaagtgaaaaatcattaatcttttcttactttcttaggctaaactcatgaaattcttatttctgtgattcgtgactgccagattccacatcacatttgcatagcttgataaaaggaagaaatatgcaggtcgaacaagtagcccattagaagcaagaaaaataaaagagtattttggccatctgaagtaggtaatgcttcaaaccccaacttccaccactaaatcacaagaagctaggatctgtttctctcagttgtcctttacatgacaaataatgatagaataagaaaggaaagaaaaagaagagggaacagcaggcaaattcatttgtctgtgattgattagccttttgtgacaaaaaatatagatcatggtatgattagcccacctgcattttccattatcttgctgtgcatgtgtggtgggcactagtggcatgacatgattggccatgcactggagatatgggtggcaattctttaaggtctattagggttgctttcagctgtgctttatcagaggcttcaaacctttagcaaaacctgagggtactttcactttacatggtccccccaaatgttgtaggctgctttccagatttccaactcttctgtcagcattttgtggataagtaacaaaatcaagtcggctggaatctgcttgtgatgaccatatggtggaagatctagttagagaggaagtgcaggatttttgaaactacttctcatcacactgaggctttaatggaacaaactaaaatttggcttgggcggaatggtcttcgatccattgctcctatcaaattttcttatgagttaaaaacacttgtatctcaagtcggctggcgttagtcttgttcattttaataattcaatctctcaatgaaatgaagaaattgagaaacacattttcttctcaaaaacaaagtcaagtcatcgaatgaaaatctcataaatttcccaatgtcacagcacaaaaccctggtttaatattactagttccttgcttttaatcaaatcatgcatggtcagaaaccataaaaattggctacattactgcatttgagaagtcacgacttatctccggaaacaatgtagttggatgcatcgagaatttcaattcgaaaaacatagctcaagtaatcgatcatttccgatctcaacattttaagggattctagtgtattataatctgctttcaactggatgattttcaacactcaatgcatcacaaagtagttttcacaagcaaaatccagaaggcttgggcagcacatcatgaagtttgaggttgcaaatgtagatacgagtgagaagaggaaggtgaatgaaaaagattgatatcgttggtttctttttctaacacatgatgcccgccaccccccccacccacgcgcacacacacaaacacccaccaaaaaaagaagaagaagaaaaaaaaaagagaaatctttttaattaaaagaatgctccggatcatgaattatgaggacaaacatggctttaattttcaagttttggttcgaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaatagaaatttctgtccgataattattaaaatttattattaaatatataataaaaattttactatagaaatttttatttattataatttaaaattatgctattattatgtgcccatcaccagagctggaccccagtcatcaacgagcgagtgcattttcgggataccatccgctcaagctaagggcttgcgggacgaaggggatcatcgatcccgtctttgttccaactcctcgtccatctcggatcgttcaaagaagaggaggaaggcgaaccagaagggaagacgtcgtccgattctcaaggcggaggaagagtgaaagaagtccagaggggagcaacgatgggcgcagtgaagaaggcggcggaggtggccgcgaaggtgatcgatcggaatgggatgatggcaaggcttatcgcctccaaggaggccctccgacccaagctcggccaggtatcaaactacgtctctctctctctctctctctttctggaccgatcgatagatttcatttctgcttttgattcgaaatgaagtggaatgagtgtccaagaaattaaaatttaagacggctttttctttagatagataggaaaggcttgggctcaactgatctgatttcaacactgagctttcatttttttcttttccccaaatctcacaatgtcttatgtgaaaaactctttgacgagattctggagatgatgattttttttccttttttcccttttaagtcctgtgcagctgtgctgaagattggaatgggaaaagaaaaagttatttcgatctttttgatttgatcagcacagcgatccgtcagtgaaaactcgattatgtcttatttgcttttcataaatggttattctagctcagaagctgaaatcctgtaacctcgcataccttcaaacactctgctccctgcaaatatcactctgtacatattcactgacgtagcattggcgaataaacaagaattcacaccagatgaaaaccttcaagataacaaggaagaatcctagactccaaatggagaaaataatctggcgatttttattgataatgatcgaataaacacaaaacaaacgtatttatagtgtctcaaccctaatatggatagttgaaaattaaataaaagctaagaatacggaactaaaccaaagatagactcctaaacagaaaacggccttgaaacccactaaaatgatggattttgggccctaaaactaaggtgaataggtaaacatggttcataatcatagggctcggaacgagctttccattgatatattatgggtccgtaactcttcttagattaaaagttgcggccatttgaagcttaggtccatgttttgactctccaacccttttgtttgggctttcgttgcttcctgcgatccatttggcccaagtactcttcagccagatgttccgtgtcattcactttaataaaagttggatggctttttagcttccctattcatcgtcaaaaaaaaagaagaaagaaatccccatgctgcctaggtttgtagctatattcttagtggccatgatagtcatagctatcaaaactgaccagaattttctttttgaggtctgcaacatatgtaacaaaaaaacctcaccccaaaaggctagctggacggtttttttgggtttccttgtaccaagatctatctcatgcatagcaaatgtggcactaaatatgtttgtatgggttctcacatactttccctatttaagctctagcattcttgtgaggctaaggatctaaatccatttcgatataatcacaactacgacatacctaatcacaaacaccataaatttgtttagtgttgctatctaggatttaccccttaattgtctagagcactagtcgtgggaggaagaggtctgtagggcaccatgttgactccttgaatctggcaagggccatctttcccttttaggtccggtttctaaggagaggccagggatggaggatggttgtggaaatttgacatgtcaatcccgagcatgtaacttccggattgaagctccactttccccttctaatgcgacttttgagatgtggctaaagaagggaggggcttggctcaacactttgatttccttcacggaccatctgatgatgggatggaacctagagggttggaatcaaatgacctaggtgatatgggcttaaatgatccaacctaattatagttccaatatgcttgattggtgagctttgctttgagcaagttggacttggtggactattttgcacttaggctccgtggtgagctaagtgatctggcttgtggagcaggcctgagtcgcttcttgggtctgtaagctgaataggcctccatttggatgcttgcaatgctagctatggctcgccaattgcatgggtccttggccttccattagcgaccttggctctagaaggatcctgaactaagtgccctagttggcttgaaatacagtgccactactgggatgtgtcaaccttatgctgcacttgatctggggatttgctcctagcatacttagctggtttctgcagccattcaagcttggtgggaaacttggtgaaaatggatgagtgaggcatataggttaactcaccttcttccttccaaacaccggaatgtttgctctaggcctgttgttcctaattggtactagctagggaccaaacaagggtcggtgattgatagttccttgctccctattatccctacctagttgaggcttcgaacttgctttggtttgtactagtataatggccattggaagaagtaatagagtgatagatctcaatgctctattccaccatgacaaagtttccccactttagagttttggtaacatgaggagtaggtaggactagtgctgggaactggaactcctcatcctgctggccaatttgtgtgcatcaaaaacaaaccatcagcgcattctcataaataagttgttgccagaatattttatacttaatttgaatcaatcaaccaggcttcaagtgcgaagtaatatccaccctcaggcattcttgagcaaaatgacccttcttagataatcgatgatatcatttataaacatgggttggtgcagttgaaacaatacttaggatcgtaaatttttacttccaatactctttcgatagcttgggaagcctcatccatgagggttcatgcactagcacctagttggtgatcaaccaggggcccttcattagaagcacttgaatagatagtggtcctctgcaatcatgaaggcatacacatcattcaatatctttctcctttgtttgagttccttggctttaaatttcatgtgtattctttgtctcaaactcttgaccgctaccattgtggattccaattcccattgagcttcctccatcccttctttaggtagcaccaacacattggcatagtggctctgtaaggtagcactttcctcagaaattctatgggtgtgccaaagtgattgctgttgctaaccctggactgcattcatccaagagagccccttctcctcatctccatggttggatgcctcctctcccatagagccagccattggtggtgatgctgagaggatattgctatatttgctggtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatataaccttttgtttcacattttagccaatttggatcgattatagccagatacaattggtgtgaatccagctttcattagtttgactggttttaagtagtgttcccttcaaaaaggctggtctaggtggactcagtcagagatgatcaggactggttgtggatgctatatttattatttggaactttagcgtaattttgaatcatttctttatttcttcaactctagggtcatttttcgttagagctagaacaagaggtttttgagtcacatattagcatttcttgtctatgttaattagttgttctagtaaaattttgtattttctaaaacttatcaattgtacactggatgctatttgtaactatgtttaaatcttatgagccaggtcttctacttagagtggcttacccacttcaaaaacttgtcgctgcactaatttctaagtgttcttctattctagattgttttgagtggttgctcctgcatgctagcacccaagtccactctcacacttgctcccccttttgacatctaaggtatatttaatcaaataggcatatatcctcctatattcttgagaaatattaataaatgaacagaagggctgcctcaatatgctttaatttccaattatttgaaaatattggatcactgaatgaaaactatgtgtatatgcaatatagatgaattgtttctttttcaaaattttgactatcaattgtctaagactactatggtgcctactcatgagtgaaaactctagacttaaaatgtccactcctgccacccacccccttcccccaacccctgcttggggcagcttttgagaagattggaagcaattatgagtttggctttaagatatataaaccatactcttctttttaaagtgtgctccttttatctgggaaaagaattgtatgcaaatttatgtctgctcattctctcttatatatgatgacatagttttctatttgataattagattattaccaaatattgaaacatgtgaataatattttacactttgagttgatagtataatattttaaattgatgagtataatgttttcattgattttcagcattattttaattttcctagatttcgtatgcaattggtaaatggtgaaataagataaagtcaattgttccaacaatttaaaatactctaaaaatttgtaatataggtagtctcttggcttgccttattttgtccttttgtcgatggcatatttctttaattttgtgacaaaaactccataacttggatcaaatatggtgggccaaattaaaactgaaactgagctttcaaacattcatggtcatccactaaggactggctaaacctaggtccttcaagattttagacattaattggatgtggaattgaaatagctgcgggcttaaggtacatacttaactcaaaatgggacgaccttaactttatgttacatctaagacagagttcttggggtctaggatttcaattcagattaatataaaatcaagtaaatgaagtttaactagagttttgtacaattgatatccaacttattccaatttggatatagatctaacatctaaggcttggggttgatctacaattttttggatacaaaaactgaatggggaaaagctagctgcagcagccagctagcttgaatctctctctctccctctctctcttactttcattccctccctctctccctcccctccacccccaaaaccaacaatttactaaaggtagagaagaatatgacttccaatgctccaaaggtaaggtaatttgaaatatgataatggactagttaaggcattcggataaaattatggcattagaataccatggagttagaaatctagttccatatgtattatttaaagaccttaaaagaaaattgagatacccatggaggacatatcctcttgataagaagttgaaccaattatctattttcccctgtatgataataatgcaaaaggataacaagtgtctaatatcatcatatccttattgttttattcgaggatttaaatgtctgtcagcctccaaaacatggtattttggttcacctttattggtaagagaagtttagactttagagtaggaagttgattatctggctacttatcactgttggtctcttcagttactggccagttgcattctttctttacgaatattccaatgggcaactattgtctttaccaagtacaaaaaagagttggttcagaagatccgccttggccactgttgttggatgcaatatgggggagaactatcagtaatactatgtggagccaagagtagaagatgtatggagagaactttaggtgcctagattctagatatattttcattaacaggaaaatggtgcaacacttggtaattcaatgtctataagtttatatccagtgattcgaccatatcattatgaatgaccctagtgcgattctattttaagattttaaataacccacagtgaagcttttagatctattaaacttggtgaaaacagtggaggataacaacatatgatatacaagataaatatgggtttaatcagtgaaagtttgaattatacaggtttgatcaaaatatattccatttaatcattttctaccattcttatagaaaaatttttaaacagattgtacataaaggcataatgtaaaatatagttatggtgtgtggatgaattgcatagatgctcttgtgtttctttgtgattattgcatctccctccctcccttcctcaggggaaaaagtcaaaaaaggtacagtaagtcaaaggaggtatggagtatgaacatagcaacattcaatactaattcattaattgatgtcatctgttgtaattaagcatgatgcaaaacattgaggcagggctaggttgctgtttcttgaaagcattaattatagggtttgtgtgagtctgtacatgcaatcacatacatatgtattatgtatgcatgcacatatctttctgctgaatagttttaatattttcattttagcactctctctgtggacaataggtgacatcacagtggttgggcacttgttttctgtctagaagcattccattgcctagacagctgatatataggattattgggtatccatgctagtgacagactgagaagatatagcacttgtgcaagtttgtctgaaaattctgaaatataattttttttatttgtgtttttacaatattttgagaacttaattgattatgagtatctcgtactacatctacatgtatgggttatggtttgctaaagtctgacataaggtatgctttattactttatctccaattcagtaataatactgaggaaagaaatgttttgtggacaatctagaagaggcagattgtagcgtctttgtgtaagtaggacctagttgttgagaaattgagatggttctcacttaataattaagtgtgaggagacctatgccatcttaattatatcatttacagagagattttcttgcattaaggcatgaagcaaactattgataaaatctgcatgtacatcatggcacctcgagtataaggattgagaagaagcttgaatctactgcaaatgggcaaaaattgatccatcattgtcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccgaccgtaagtcggtcggtcggtccctccggccatcgatcggtcgatcggtgggtattccccaacaatagtttttttttttcattttgagagatcattcatttctgctaagactatatatataaatagagaaaaatgatggatcttgctcttctctagaggagagtatgtctattcctcttgagcccaatatcaataatagggcatctaactcaaagatccacttttcgtcataatatatatcactaaaaatatctagaaatcaaaaatcaagtgttttaataatctttgctcatgcatcaagtgagtgcaaaaataatctctgatcatgcatctagtgagtgcaaaaatgaagggttaagataatatgagatcatattttgttatgatctaaaaaataaatatatgatttttttatctttatatatatttaatatgtataaattgtgattgatataagatggatttgaatttaaatactttattatatattttagcatactaacataatgaaaactatttcattttttgtgccgatacggtatatatgggttactaattaataaaatatgtgatatttgatttcttggcttttagtggtttagattatgctcaaccatatgaatttcaatttaaatgctatattattaattttgaactcgaaaggagaagattccctctcctcttgagaggagcaaagctatctcatgtacataagaaggattttgcccctttcagtataagaagatatctattctttttgagttctaatcaataatgagaaattcaaattaaagattcatatgttatggataaaaccttggtgcccggctccgaaaacatgtgtaaactctgattgtgactgacctacacatcgatcgtcgatccgtacatagggttctgatctcatggtccatattttcaaaagctgtcaattcacttttgagctgccaaccctagcatctgtgtctgatcccatctctaagagaaacgggttaccaatctacgtcttgaccatcgcctcatcactaatggtctccagatgtcgaacatcaatctaaatttttagttctgactcccatatcagcttcgatcctaatatttattattagagatgtctgatcaggataccacctctacaagaccttttcgataccacgcatcacagcagaaagaaaaaagaaataaactggaaacaatcaaatacgtggatcaactaaaaaaaagctcgctttcgcgggacatgcaagcttcactatgagaaaagagaaaaattataagaggagatcacaccctcaatcctcatacacccaatctctccctcacaaaaaaattttcttcacaaaagctctctctctaggaagatcctcctgaacccttaaattaatcgatgttcgctgtctgacagtttgtctgaagcatcctatagttctactttctgttagctaccgctgccctctgctccacggtttaggtctccacagaaccaccatacccatctctattgccacagggtgagtttataagcctcggaacccaaatcggatcgaaaactgactcctatttatgtcaaactgcctctctagccgccagatcaagatcgactcctgtcataaccatccgattgtgcaacatgagtcttcgatccacaaaaattcttgtagattgtgagaaactagtctgaaatgcccttcgatccatgatggactgcattaaaataaggaaaaatgcccgttcggtccatgcgggtccccatggaccatcgatgggccattgaaagtcgcatgggccgtacctgtgcatgctcgcttgggtctgggccgtgccttgcgtgcgcccgcccgtctgtgtgctcgcgatcatccggtgcaccgctgcacgcatccgctccgccagcttgctaccgaccactgtcggcctccatctctccgttagccgtgccatcttctatcgagcgtatctccttcattcgatctctgtttggattgatcttaagctcgttggactccattcatcattgcagtcctcactgtaggttcagtgtagatcaaatctcgagacatcaaatcttaataatctctactttgactcgacattcgatctcctattaattctgagagcttctggatctcctcgctctctactctggggcaattacttgctgatcatggatggacagacatggaagtcgagccatgccactcgatcctatctctatcatatgctgtgttcttcttgatatgaaatctgctcgagttatcatcctatggcaataagaatctcatcctgtgatatcgcctctcattctctcgagtctcacatctcatgtctgatccacctccacctagagctctacctcactctggactctttttggctcctgaagcttcacctcacactgagctcttcgtcaggtagtaatattctctcgttctcttttttttcttcagaataatcctatcaccctgcaacaccttcaggattcctccatcagctaccatcctgtagcatctagaattcagtttgcttagtgagataagattctacctaaaatcggatatgcatcggacctcccctaatctcctcacagtgccatcatgtatcctccagttgatcgtctcgatgcttctgatcgcatagttcaatccattcgacagacaaacagtacctcattgctctttagggagtcaaactactcctctctgtaacatacataatagatgcatgcagaatctaaaattcactactggaaagaagtagatacctcgtcagatatctccagaacatcaccctctgactcactactggtcgacgttgcagtagctcttgtctgatccctgagttgagagcaatctctggctagatgtcccaacttgtcacaccaataacatttggtcttactcaagtcctttgtcctggacctgaaccccccatcgtgatctcctatcgctctgtctaccatctcctactcctccagaaactaccaaagctgagctgccatctgagcttgaagctgggttctcccttcagaaaatcttgttctgaagaatcaccatagtgaccttgtccatcttgatgatattcttccccataagaagagtaatcaccaagaacttatacgaagaaagaagcgatgctagcaagaccagcaccatgatcttcgcctcaactttcttgccaatgctaaagaggtcggtgagaatcttctagaagtggctgagatactcctgcatgctctgtctctcagtcattcgtagttggtagaactgcctctagaggaagatgatattagtgagagacttcaccatgtacaactcttcgagctttgaccatagcactatcggagaagtctcaccaagcacatgaatcaccacctcattgctaggtacaggaagatcgtacccaccatccacatttggagccgtctccaatcctgcaccttcgtggtagttggcttctcctcgcataagagagcatcgatcaatccttgctggataagcacgtccttcacctttacctgtcacaaggagaaattgctctttccatcaaatctgttaatctccatcttgattggtcctgtcttctctatcttcaatcttgctctccactgtcgcaattcgtattttgatactacctagctttgataccatttgttgaggatgtctagccaagacaccacctccacaagacttttttgataccacgcatcgcagcagaaagaaaaaaaaataaaacagaaacaatcaaatatatggatcagcaaaaaaaagttcgcttttatgaggtatacaagcttcactatgagaaaaaaaaaaattataagagaagatcacatcctcaaccctcgtacacccaatctctttctcacaaaaagctcttcctcataaatgctctctctagaaagatcccctgaacccctaactgttgtctgctatctgacagtctgcccaaagcaccctatagttctgctctccgttggccgctgctatcctctactccacgatttcaggtctctacagaaccaccatacctgtctctgttgccacaggatgagtttacaggcctcggaacccaaactagattggaaactgactcttgtttgtgtcaaactgcctctccagtcgctagatcaagatcgattcccgtcttaaccgtctgatcgtgcaacatgagttctcgatccatgaaaatctttgtagactgtgaaaaatcagcccaaaacatccttcgatccatgatggactgtgtgaaactaagaaaaaatgcccacccagtccatgcaggtccctatggatcgtcggtctacacatcgcacgtggaccgcgtgggaaaatcgtgcaggctatgcatgcgcacgccctcctgggcctgggccatgctcgtgcacgtgcccgcacatctgtgcgctcacgactgtctcacacaccgccgcatgcgctcgctccgcctgtatgccgccgctcaccgccggcctccatcgctccgtaagtcatgccatcttctatgtagcatatctttttcatccgatctctgtttggactgatcttgggctcattggactccattcatcatcgtgaacctcacgtggactcagtgtggatcaaatcttgaggcaacaaatcctaacatctaccatcgatccttatcttcaacagtacatggagcaagctatgaagccacgctctttttgacctccattttgatcaccatatttgaaaaatttgacaaaaaatcctaatacagtcccgtcagatcaggctaccactggaggcaactggatatggatcagataagacaactgcaactactttgtacccagaaatcaagccgaagatagcgggatagcgcatccaaaggagtcgaagcaatctccaattcctctctcccatggctctgacctctatggtcgcatttgatgatctcaataagatcaccatggtgatataagatcaccagtgatctaaatcgtgaggtaatatgatcaccagtgatctaagatcactatgtttggtaggttatggtccaataattaaagattctcagatatccatgagtaacctatttggtattttatgaaaatccaagatcactaattatataataccaaaatatcgataatatatcccatagatatatatttattaataatatataattattataaataaaatattattatatttattaatatattaataattagtagattctataaaaatatatttattacttctacaaattattaatcttataaacatatattaattatttatgtatacttataatatattatttattaatatgaatatttattttgaatagaaaaacatggcaaatggaagtagtatattatatatatttattttataaatataaattataataagatatttttactctaatttaaaattaacattgaattataatgtgataataatataattaataatatattataatataatatatatcataattataatatataatatcaaaaataatataatattatttatagtattgatataatatattaatggtatattaatataccaatttttttattagactgagagggggcgtttggtatggggtggtctattcaagatcaaggatgatatatatggagctgatgaaatcatcatatttgattgtatcataataattctatgtggcagagatttcaaatcacccacatctctcaaatcatctcccaacccaatgataggatatccatccttatggtccgaaattcaagataccccccgagcagtgatatggggctaaaatataaggacaaaattattcctcaatctaacaaaaaaagatacatcaatataccattaacatattatattaatattataatatataatatcatataataataattaatatatttttataagattaataatttatagtactagtaaatatatttttatagaatctattaattattaatatattaataaatataatcatattttatttataatatataatatatgattaataaatatatttttatggaatatattataagtagtgttggtattgtataaccagtgatcttgaattctaattaaaacaaaacaggttactcgtggatatccgaagatctttaattactgaaccatcgtctatcaaatacagtgattttatatcattgatgattcgatgagtataaaattcagatcatcggtgatcttagatcactatgatgatcctatttggatcatcaaagactatctgagggatattttttatccttattgtaaagaacaatagaaagagaaaagatatatatatatatatatatataggttatgtaaaaaaaaattattgtgttattcttttatgttacaggaggctctatatatagagtaataaagatctaaatacaatgatctgtctagattcaatgaaccatataatagaggtctagatttgatgaaccatctaaatacaatgaaccatagaagtctagatacaaagaaccatctagataaaatgaactattaatctcctaattgatatcttttctaaacaacattatacaccataatgtataccataattgatctctaacactcctcctcaagttgaagcatagatattaatcatatccaatctattacaaatgtagtcaatcctattccggtttagagccttagtaaaaatatctactagttgttctccagttctcacatgtttgacagggtcaaggccttgttcgatcttctcacgaacaaagtgacaatcaacttcaatatactttatcctttaatgaaacacagggttagaagcaatatgtattgtagcctgattatcacatcacagtctcataggcagagtacttttgaaaacaagctcatcaaacaaatgacaaatccatatcaacccacatgtggtttgttccatagctcaatactctaactctacattgaatcgatctaccatagtttgcttcttactttttcaaaaaatcagattaccactagcaaaaacacaataacctgaagtggacctttgatctataatagaacctacccaatcagcatcagagaaaacttcaacttcatagtggctatgattcctatacaagatatctcaccctaatgctccttttagatatgttaatatatacagaactgcctcccagtgagtagttcgaggaaaaaatataaactggctgaccacactcatagaaaaggcaatgtcaggatgagtgactgtaagataattaagcttaccgatcaactttctgtatctttatgggtcttggagaacttctccattatctaccatgagtttcacattaggtatcatgggagtttcacatggtttagctctcaacatatcggtctccttaagtaaatctaggatatactccctttgtgaaagaaagatacccttcttacttcgagcaacctcaatttctaaaaaatattttagagtacccagatcttttgtttgaaattatgtctggaggaaagacttgagatcattgatcccagtatcatcacttcctgtgactagttacaatatcatccacatgcacaataagcataatacaaccgtcacttgaccgccaatgaaagattgatgatcaaaattatttcactacaatccaaactgcaacactgcctaactaaaatggacaaaccatgctcgtggacattgttttagcccatatatacaatgacttcttgaagctacatactttcccactctattcttgagcaacaaagtctggtagttgctccatataaacttcgtcttgtaagtccccatgcaagaacgtattcttgacatttaactgatacagtggctgttaataagtagctgcaagtaaaataaatagtttaacagaagtaagtttagcaacatgagaaaaaatatcagaataatccgctccatacatctggatatagtctttggcaactagatgatcattcaaacaagcaacagaaccatcaggattaacttttacaatataaatctatttatatctaatagccttcttactactagataaagaaaccaaatcccaagtttgatttcgctcaagtacagtcatctcctcaacaatggatgcacgccatctagcatgggatagtacctcaatgatactagtaggagtcattatggaatcaaaagaagccacaaaagactgagttgatagagataagtcatgattataagagacaaataaaaaaatggggtaggtactgttgaaaattgtgtcccaaagctaatcgtcaatctgttaacggttgagctcattattgtaattgtatatgaattgttaaataataaatattatttaattttttcattacgttgtacatcttctttgcactcttgtacagtgatgaagtccttaggactattgggatcgatataagaggatatattgtttaacccttaaacctagttcacgatcaaatgatacgctattattaggacgatagctatatcaagtgtaggtcattgtgtgtaatgaacgttggttgtcctcttaaccaagaagtgtggagacactgacatggcatgcaagtgagatgtagatgtacatctcattgaacgtaaccaactgcagagcactctgctgtcaagagtagctcgtgaaggatatggatataaatatttctccaatctgagatcactatgatgacttgcaagtaactcactatgctttgatactggattacttaaatttttaattcaataataaaaaatttttggacacagtcaagtacttacaaagtcggtgtgtgagtcaaaatggaattgacccatctaaataagtaggagttaatgcatcaatgtatttcaattcagtaaaacctcgattgggataatctatgtgatggatttaaaaagttgaaatacaatgtagataattttttttagattggcagtaaaattctaggtcaccttgagcattaggatcaaaagactaaattatacgataaccatatgccaacgagtattgtttagcaatttttcaatctatccgaatgtcgggtatcattgatagatgatcactttgattgatataaaaaaattatttttgtactactgacttaggtttaaacctatagggtcacacttaaaaaaagtttctgactgatcatgtagctgatcgatgattgagaatcatttcaggatataaccgtcatttcgattgatgattaaccttgcataaaagttgtaataaattaattcactaatgattgatgaaatatagaaggagtgattagcaattagattgctaattaattaaatttgattgagcattaagatttggatcaaatttaattgaattagattcaatttggtttgacctgattaggttataagatgacctaatcgctaagagtgtttaatttctgatttgatcgaaacttgaatttgattaatttttaatttgattaaaatttaattaaaataatttattatctaattaaattaggttcaatggtctgaatgggtacaacctaatttagtttgtttgagaacctaattggataaaattcaagttcaaatgaatttgaaccaaagcccatgcgccaccctatctctgcacccttcttttcttcatgtgagaaatatttctacatgaatgtttctcatgcctagaaaaggattgatgcctactttctgatctcctttggatttggataaggttggtttaaaatttgagttcaaaagatttgaatttgaataagaacttagagtccaaaccttattggactctttccaaaattgccgacctctcttcccatgtgagaatcaatttttgtgagatgattttgcacaccaatttgatgtttctcacttctcttttgcaccctcttgagataggataggtttagttaagtttgaagtcaaatagatttgaatttaaactaaactacctattgtttatcctatcctatctcatttccacgacaaccttaaaacctctctatttatgtgcaacaaaaagagagtttttaccatggaaaatcatttctgagagagagggggcatcaaacagagagggggtgggtcattctgtgtgatagaaagagaaaaactgtttcctctttaggcatgagttctaaggtagggtcctagggtttcgactctagatttttgcgagagaaaaaatcaagaggatcttgttccataatttctacaccactatctcttcctattgttccatcctctaatctggaagagtccggataatctaaaaaaaaaagcacaaatcagtcattcagtacctttcgcacgagctagtacttctgacaaggatgatttgatcgaggcttctagcggatatcctgtaaaggtcagacatactgtgcggctcttcaacatcaggaaaaatctattatcatatctatcaacaacgatgatcatcgatccacattctggtaaagaatctaatctcagtggttaagatctaccattgattagtttgcttgtttcagatttgatctgcttacgtgattgacatgatcaatcatacttaaaattagatgttgcatttatttatgtcatatgatcctaattaggtagtttctaaatcagatttaggacatgcaaatagattaaattgtttaatctgtagtcttccactaaaaaaatttgaaaaatacatactttgaactatcgattttttcttcaaatggtattagagccatgcttcttagaacatgtatattatacatataatctgattttaattatttagattagatttgaataattaatcttaattctaagtagtgtagtagttgaattaggtagatcgccatagccgtctggtcataggagaaagtaggatttcatgactctgtcctcccattcgatgggattctcctatagtgtgtagggatactgtgcggttaattttcataaagatgaataatgaaagaagcttaaaaaattattttagatctaatatatcgtatgttagatttgaaattaattttcagttgattgtatgataatttataaaaatattttataaaatttaaaattatttttaaataccgaatcccaatctatatcagtccaaaacttaattaagaattaagtggtctagatttgagaatcaaagatctaagacctaattttcataaatcatggatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgttagtaattgatcaaatctaattaatgattaattttgattgggttaattcttctcttgatcaatttttaatagttatagttggtcagagtccatgtctttaattagaccaagatggatttcgatcatagctttgtggtcaaacccaagtctataagttgatcgaattgaaactaattaatcagttggtgtctaaggtaagtatgacagtcttgatcggtggtcattaattggaagctactcgcatagattgagtctatggtgagttaatgacatatcccttccatcgatctcacttacctgaccaacatggtgaatcatgctttgatcagatcacttaatgattagggttgatccatgctagttagaaaatcagtatgactgatttagatatctccagtttgacttatctatagtcctctttatgacttggtgaagtcagtgagaggatttgtgactagtctactagaccaacttgtatctagtcttatttgatctgacttggtgaagtcagtgggaagattacgattagctggttagccttttctcttctctcaatacatctaactaaattctctaaaattttagatccttaaaaatgaaataattatgatgataactagatcatagcctcctattaagttggatgataatagatccaacagttgagatgatcattggaggtgccacatgcctgatgctcatctggctgtcagaattgttactcataatatgttgatttagatgtatctttctaacaatggttaggttggccaagctacactcaggcctgatcattcgattgttagatgcactgaattctgacatgttaatgattggacctaatcaagactttcagtggaggcaccacatgcttgctgaagaggtgcctggagcaaaattaactactaatagttgtttgatgaaataattgattaagaacctacccatagatgcacaaagattggtcgagccacactcaggctcatatgcaacctataaggattttaatacccaccaaaaaattagtataatttctcgaattggaggtagaggctatcaatttaaataaaataatgaaagaatctttaaactaaagttcatatctttaggcttaatcaattcatatactaattagattttgatttttttttataattatggccaccactttatcgctccgatcactattagatattgttaaattgatgggactcaattttgatagttggtatcgaaaattcaatatcgtcctgaaacatgaacggatcttgtacgtgatgacagatccgacatccgaggagccagtctcgaatgcttgtagtacgatccgagatacttatcaaaaatcactcaatgatcgaaccacggtgcgttgtataatgttgatggttatgaatgatgagttcaatcgtagatttgagaatgcttagccacaagacatgcttcaaatattgaacaagtcttttggcacatctaacgatgttgagaggcacaagaagttgtgctatttttaatgctcgaatgagagaaagagcatcagtcactgatcatgtattgtatatgatcgagttaattgagtgtttgagcaagctcgactttctcctacatgagtagctggaaaagaatacaattttgaactctccgtcaaaatcctacatctcatttcttacccattatagaatgacaaagcctacagtcgactatcataatttgctgaggttgctgtaaaattatgagaaggatcactagctctataaagagtcagtgaatatgatgggaggatcttcttctggacgtcgaccttttaagaaagagaagaagaacaagaataaaaggaagatgcaaagtgctgaggagtgccagcccaatcagataaaaaaattcaaatccaatcagagtcagtcggaatgcttctactgtaagaagcaggggcactagaagaggaactgtcctcagtacattacctctctggatccgaacaaatcgagaaagaaacaagctgttgctagataagataattatatgataataccttgtaatttttctatttatgatttcactatttgggtattagatattagaagttcttttgatatatgcaatttgttgcagggtctgcagattagtaggagatttgaagaaggcgaaaaatttcttaatattggagatgaaaaatctgtttcaattctagtattagggattgttaagtttatattcaaatctaatgtaattgtgcttagtgaatgtcacttttgtcctttatttttattgaatattatttttgtaggccttttggccatgaacagttatgagatttcaataattttttttaatatcattgtgaatggtgttaatatgatgaatggacaactgaataatagaatttatatattatcacaacttgttagtgtaatgcacacgatcgaaaaatatcctagaattgatgatgtctctaatatctacctttggcactgtaggttaagtcatgttaatcagaacagaataaatcgattgactcaagagaaaatcttcgaagtcaatgattgtgaatcacttccaatctgtaagtcctgttttcttgaaaaaatgatcaagtcatcttttattgaaaaagatgaacaagctagtgaagttttaggtttaacacatattgatatatgtagacccatgaacacgagtaccagagatggatatttttattttattatgtttacaaatgatttatcgaggtatgggcatattatttaatgacacataagtctgaatcatttgaaatattcaaacagtttcgtaatgagatagagaaataaattgagaagaatattaaaactcttcagtctgatcaaggaggagaatacctctctagtgatttttgatatatttagcagaaaatgagattctctcgtagtggacccctcttgaaataccacaacataatagagtatcgaaaaggaggaatcaaattctattagatatgattcgatctatgatggactttgcaagtatgtcgatctctttttggagatatacacttgagtcagcttgttatatgcttaataaagttcaaagcaagtccgtaagtaaaacaccatatgagatttggacagagcgtaatccagtactctctcatcttggggtttggggttatccgagttatgtcaaatgtttgaaaatagacaagctcagatttagatctgacaagtgtctatttatagggtactcaacataaactaaggggtattacttctaccttgctgatgaacaaaagatgttcgtcagtaataggacagtctttttgaaaaagaagtttcttgaggaagaaactaatacctctgaggttaaagttgataaagttcaaccgatagaagaaccggcataatatagtaaatctatagagtcggatttgattagatcaaatccaaaacctgttatagagacatctttaagaagatccgatagaataccgcatcagtcgaatagatactatggtttcttaatctaggacagtgatcctattgaactcgatgagaacaacaaggatccgatcacctacatggatgcaatgcagagatctgactccgataaatggctaaaagtcatgaagtctaaaataaaattcataaaggtcaacgatatatgaatattggttgatccacttgaaaagataaaatctatagggtgtaagtggatcttcaaaaagaagaggggcactgatgaaaaggtgaagatctataaagtccatctggttgtcaaagattatcgttggtattatgatattgactatgacgagatatttttttctgtggcaatgctcaaatctattcagattatgtttacaatagcagtacacctggactatgaaatttgataaatggatgtgaaaatgatcttcctaaatgaaaagctggaagaagaggtgtatatgatacaacctgaaggtttcatatctacaaataagtctaagatgtgcaagcttcaaagatctatttatggactaaaatagacatctcatagttgaaacatgtattttgataaagtgatcagaatgtatggcttcattaagaacagagaagaaccctacatatataagtggatccataattttgtggtcatattttttattttatatatgaatgatattcttttgatcgggaatgacatccctctattataaggaataaagatttgactgtcgtcacagttctctatgaagaatttagaagaagcatcctacatatttaggatgaagatctatagagatagatctaagaggttgcttgggttatcccagtccacgtatattgatgctgtgctgaagtggttcagtatgaagaatttcaagaaagactatctttcgataggtcatagaatttttttctcaaagcgagattatctgacaactcctcaagagagagagcgtatgaatagaattttcatatgcttcgatagtagaatccattatgtacgtcatgacatatacgagatctgatgtagcatactcactagaggtagtgagcagatatcagtccgattcagatgaaaatcactggaaggtcataaagatcatttttaagtatttaaaaaatactaaagaccagtggcttgttcatagagaatctgacttaaaatttatggagtttacagatttcaattttcagtcagatcataatgatagtaagagtatattgggatacatatatatcctgaataatgaaagtctgctgaaaatatttcaagcaccacaccatgaccgactctacttgcgaggtggaataaatcgcaatatctgatgctacgaagaaagctatgtagttgtaaaaatttatcgacgagctcggagtgacacctttcctcgatggccttgtcatgttatactgtgacagcacaagcgtcattgctcaagtgaaggaactgaagttacatcaacgtaccaagcacattctgtgctgctaccatctagtccgagagaacgtggatcgagatgatgtcgagcttcagaagatcgacggaaaggagaacccacccgatccatttactaaagtcctcgatgtcaaagagttcaaagactataaatcgaagataggtatataataatgtatcgattgactttagtccaagtaaaagttgttaaaaattatgtcccaaagtcaatcatcagtctgttgatggttgagctcattgttgtaattgtatatgaattattaaataataagtattatttaatttttttcatcactttgtacatcctctttgaactcttgtgttgtgatgatgtccttaggactatttgaatcgatatagaaagatatatcatttagttcttaaatttagttcacaaccaaataatatgctattattaggatgatagctatatcaagtgtaggtcattgtgcatcatagacgttggttgtcctcttaatcaaggagtgtaaagacactgacatgatatgcaaatgagatataggtgtatatcttactgaacgtgactaactgcagagtattttactatcaagagtagcttgtgaaggatatgggtataagtgtttcttcgatctgagatcatcatggtaacttacaagcaactcactgtactttggtatcgaactatctgaatttctaattcagtgatgaaaaatttttgagcacaatcaagaacttacgaaatcagtgtgtgagtcaagatggaattgacccctctaaataagtaatagttaatgcatcaatgtattttaattcagtaaaatcttgaccaggataacccatgtgatggatttaaaaagttgaaatataatgtagatggttttttttggattgatagtgaaatcttaggtcatcctgagcattcggatcaaaagaataaattatacggtaaccatatactaatgggcttttgaatattgtttagtaatctttcgatctatccgaatgttggataccattactagatggtcactttgattggtatagaaaaattatttttgcaccatcagcttaggttcgaacctatggggtcatactcaaaaaaaatttctgactgatcatgagactgatcatgattgagaattgttctaaagtataaccgtcaattcgattgacgattaaccttgcacaaaaattataataaattaatttactaatagttgatgaattattgaaggattgattagtgattagattgctaattaattcaatttgattgaacattgagatttgaatcaaatttaattgaattggattcaatttggtttgattcgattaagttataagatttaatcgctaaggatgtacgatttttgatttgatcgaaacttgaatttaattaatttttaatttgattagaatttatttgagataatttattacctaattagattaagttcaatgatctgaatggatttaacctaatttagttttgttgagaatctaattggataaaattcaaattcaaatagattggaaccaaagcccatgtgccaccttatatctatgcccttcttttcttcacacgagaaatatttctacatgaatatttctcacacccagaagaggattgacactcactttctgattccctttgaatttgaatgaggttggtttaaaatttgagttcaaaagatttgaatttgaatgagaacttagagtccaaatcttgttggactcttctcaaaattgccgatctctcttcccatgcgagaatcaatttttgcatgatgattttgcatgccaatctgatgtctctcacctctcttttgcacccccttgggtcaggataggattagttaagtttttaattcaaataggtttgaatttaaactaaactgtctattgtttatcctatcctatctcatctccatgccaaccttaaaacctctccatttttgtgcgacaaaaagagagtctttatcgtggaaaatcatttctgagagggaggggccgtgaaacagagagggggctagtcattctgtgcgacagaaagaggaaaactatttcttctttgggcgtgagttctaggatgaggttctaggattttggctctagatttttgtgagagaaaaattcaagagggtcttgttccatactttctacaccaccaccttctcctattattccatcttctgatcctgaagagtctaagtgatctaaaagaaagagcataaatcaaccatccagtgtctttcgtgcgagctagcactcccaggaagaacgatctgatcaagacttcgagtgaacatcctataaagatcggatatactgtgcagctcttcgacatcaaaaagaatctgttaccacatctatcagcaatggtgatcatcgacgcacgctctgataaaaaatctaatctcagtagataagatctaccgttgattagtttgcttgtttcagatttgatctgcttgcatgattgatatgatcaatcatacttaaaattagatattgtatttattcatgtcatataattttaattaggtagtttctagatcagatctcgggtatgcaaatagattaaattatttaatttgtagtctttcgctaaaaaattttgaaaatgcatgctttgaaccatcgatttttctttcaggtacaactacacttatctttacgaagagctgtgggaaggtcaagagtaggatctaagggaggaccttcagtttttggatctgatcgaggatattcaggatttggaggcaaaaaagagtcaactagtgtcaaagggccagggtctcaatcgacggcatagtcatttgcggatgagtgtagtggtgaggaagtggagcaatcataggtggatggagcctgataggtttggtacctataggagttaatgacaaagaaacagaagtgggagaggattgaatcttatacacaaaaaacttgtcatcggtaatagaagagatagatgaactagaagaaaaaggagtatatttaaagaaggtaacatctatggaaataagatatcgacccaaatcaggagaatcacaatgataccctttctgatgataaaaatatcccaaaaatatatacttgagtggtcgtggatctaacttggagaattgtgggcgaacatcctggataaaacaagcacaaccaaaaattttagaaggcaaagaaaataaagaataagaaaaataagacagaataagaaacttgaccagagagaatagaaaaaggcatctgattgattgaataacaggctgtgaaaatagcatcaatccaaaactatttagaaactttcatataaaatagaagtgctcaagccacttctaataagtgtctatctttcctttcagcaacctcattttattggagtgtaacaatacaagatgactgatatataataccatgttcgatcatatataaggtaaaagtatttgaaaaatattttttttgcattatcactatgtagagcacgcttcgtaacattgaattggattttgattttagcataaaagatatagaataaagaaaagaatttagatcgatttttcattaaataaagccaagtaactcttaaaaaatcatccacaaaagtaataaagcatctaaaatcagacttagactcgatggaacaagatccccagacattagaatgaataatttcaaaagggcatgcaacctgtttgactttagaaaaataaaagactatatgatgtttagcaaactaacaagactcacactcaaaagttgaaatagaacttaaactaggatataacttcttcagagcatccaagaaaagatgacccaaatgataatggatatcaaaaggagaaacaacacttgagtatgcaactgactatggcacaaaatcagacataatctcaagagtgtatagccttttggactcatgacctctaccaataatcctcttcatcccaagatcctaaaatagataatatttaggaaagaagtgaacattacagttgacagcatgagtaatcttactaacatatgataaattgaaagaaaattgagataagtacagaacagaacttaagaaaagagaaggcatggggcaagtagtaccactcccaataacaggagcagaagaaccattagcaagagtaatactaggcaaaatagaagaaagttgaaataaagagagaatacttgtgtttcctatcatataatctatagcacctgaatcaatgacccaattgcatgaggaagaggtgagacaagtaatagatttacctgaccgaataaagatagcagcagaagaggatctgaagccctgagaggcttagaattggatatattgggcaaactcattaactgtcatagttactaaccagcaaaaaatacctagataaacctccttctagcactagcgacatcttcctctaacaccaacagcacctgggctcaactctttcaatgtgattatataggctcaatcctgtcaccagctccagctctcttaggctgcgagcttcagaccaggtcataattcacctgggttgtgctgtcaagcatatgtgactcacttgatcgcataggatttcattatgcgtgatctttggtcatgcatcatagaaggagaaaagggtcatgcactacagaaggagaaaagagggatcttaaaagtcgatcagcagaggtagttttttttaaggattacttggaaatttttaaaaaaataatgagaattagggattgtaggttagttcagaaccctaggctctgataccatataaagaataatataaagagacaagagaaagaaatatatatataggctatataaaaaaataattgtgttattctttcatattataagaggctttatatatagagcaataaagatctaaatatagtaaactatctagatataataaaccatataatcaaagtttaaatataatgaaccatctagatacaatgatccatagaggtctagatataatgaaccgtctagatacaatgaaccattgatctcctaattgatatatttcttaaacagaaatatacaccataatgtataccataattgatctctaacatctatatttcagctcaagatcattacttgagattgatcttggatttttgatctcaaggatagatatctcatcagtgggttgtggggtgatttgagaagaaaagattatttaaaatcactgttatttaggatcatcatggtataaccaaatatgatgatctcatcatctccttccacattagccttaatcttgagtgaatcactccaaaccaaaaacccctataaataaaggtaacagaagactccaaagataagcaacttttttgcatgctctttttcatttattccagatttctaacttgagtattgggggatttctcatcgaaaccatctttgattagagatttattttacagatccgatctccagcaactccagtcaaagccagaaatctatcacaacatatatcattgatcataatcagagtactaaaattatctagaacagaaaatgatgagtgttgatagtttgtaacctatgcattatgttggcccaaaaataaggattaaaataatgtgagactattttcttaataatctaagttataaaatctattgaatatttttttttcgctaagacaaatctattgattttcaatctatatataatcatacatgtatagattatgattgattaggcagggagagatatgctgttgtatgctttgatgtacgaaggcttcgatacatcctcttaaaaatcaatgatgagctatccaaattcaagatccaaactatttggacaaactagattataaaaaagtcttaaaaatcaaaatccatatgctttaataatctctaacctaatcatcatgttagtatcaaaatgaacgataccaattatatcagtatggtaaaatatattatagggcacaaaaattcaaaatctacttcatgaatcataatctacatatcttgaaagatggatagatttaaattgacaaggttatgatgaataaacatggtaaaacataatgtcatggtatgacaatcattcctattgactcaaacttgatgttcaagtttgagatcaccacaatacaagaaattagtttacattcttactctgtggtctagatcatttccacatattccacaatttggattctgaaattggatggcatatcattatgtacatatacatactttcatatacatatatagatacacaaacatatatgtatgtatttatgcctgtactgtatatatgtgtgtgcatgggtcctgacatataactaaagaggttgggggtattatcgaccagagtttattttaataaataaaatcacttttttgatttagcacttgctatttgaggataagagaagtaccaacaaaagtggattatttttatcatgttaaataaaacttatgaaatttttctaatatgcatcctattagccacattgtacatgccaagagccagtgatatttagcaagattgattacttatgaaacaccaagctaagtccattgttcttgatgatcataacaatcggcttttaagaagagataattgaggtctttttttcatagaaaaagggggtgaaggggggcaaccagcgtagctatctcttttagacatgaccatgagggcccccaccatgctcgagaatgtttgatttggagactaggttagaatggagtccacctccctaccatatgggctgacccagggaccaatccaataggtgagtatgtgttggggatgtttggccaggacaccaccacagaatttttttgataacacacatcacagtcggaagaaaaaagaaataaaatagaaacacaaataaatacgtagatcacccaaaaggctcgcttctatggggcatgcaagcttcactatgaaaaaaaaattacaagaagagatcacaccttcaaccctcgtatacccaatctctttcttaacaagaatctcttcctcacaaaagctctctctaggagatctcctgaacccttaaaacgatcgctgtttacagcctaacagctcaccgaaagcacccctgtctttgcactctatcggctcctctcgatttgttactgctctggatcttcgatcgaacacaccacgccacttgttctgttctctattaccacagggctgtttaaagccctaaaacagagctaagatcgaaaacattgtccaccaagactcaattatcggatcaagccaaatcatcagatcaagcccagcatcccgcgtagccatcagagcgtgcaccacacctaaaaaaatgtgggaaaaccatcttcgatccacgatggaccatgagaaatcggaagaaaaacacccgacctatccatgcaacctcctgtgagcctgatccaccgtggaccgcgactcacagtgggcctaggcgcccacgcgttcgctaggccggccagtgcgcacacctgcactgggcccaccctcgtgctctagcatctacccggcctagctgtgccaccatcgatttctattggccctctgccgccccgtgggccatgctacctattttcgagcttctctcatgcatatttcttccgtctggactccatttggactgttcttggactcgttggactccgtttgtcattttgaacctcgctgtagactctttgtaagctgaatctcgaggtatcaaatttcaataatctgcacctcgacttgacattcggcctcctcctaactttgagagcttgggattttttcacctccatgccctggggcaatcacctattgatcaaggatggacaaatatgaaagtcaagtcaggccactcaatcccatctccatcgtataatgtactcctcttgatctgagatctactcgagatattctccaatggcaataggaatctcatcctgcgatatcgtctctcatcctcctaagtctcgcatcttatgtccgatccacctctatctagagctccacctcgttctgggctccttctggctcctaaagctccatctcacattgagctctctatcatatagtaatatcctctcgtcctctttttttttctctagaataactctatcaccatgcaataccttctggattcctccaccaactattattttgtagcttctcgaattcagtctgctcagtaagataagattttacctgaaatcggatatgtattggacctctcccaatctcctcactacaccatcatgtgtcctccagctgaccattccgatgtctctgatcgcacagctcgatctatctagtagataaatagtaccctcatggctcttcaaggagtcaaactgctcttttttataacatacatgctaggtgcatgcagaatctaaaattcactacaggaaagaagtagatacctcgtcagatatctccagaacatcatcctttgactcgctactagctgtcgctgtagtagccctcatccgatctctgagttgaggacaatctctggttagataccccaactcgtcatatcgataacatctggtcttgctcaagtccctcatccataatttggatcgtcctcatcgcgatctcctatcgctccatctgccacttcatgctccttcaaaaatcatcaaagttgagctacggccacctaagctcgaaatcggattcttccatctgagaatctcattctagagaatcactgtggtgatctcgtctatcttgatggtgttcttccccattagaagagtgatcaccaatgactcatacgaaagaaaaaatgatgctagcaagatcagcatcctgatcttctcatcaactttctcgccaacactaaggaggtcggtaagaatcttctgaaagtgtctgagatgctcctgcatgctctgttccttagtcatctgcagctcgtagaactacctttagtggaagaaagtattggagagaaactttgccatatatgattcttcgaatttcgaccatagtaccatcggagaagtctcgtcaagtacatgcatcatcatcttatccgttaggtacatgcagatggtactcaccacctgcatctggagccacctccaatcctgcacctccatgatagtcggcttctcctcacacaagagagcatcgatcaacccttgctggatgagcatatcattcactctcgcttaccacaaggaggaattactctttccatcaaacctgttgatcttcactttgattgagtctatcttctccatattcaatcttgataccacaagcacaacctgcatcctagtaccacctcgctctgatactacttgttggagatgtctggtcaggacaccaccaccactggatcttttcgatactacacgtcgcagcaagaagaaaaaaaataaaatagaaatacaatcaaatacgtggatcagtcaaaaagctcgcctctatggggcatgcaagcttcattataaaaaagaaaaaattacaagaggagatcacaccctcaactctcgtgcacccaatctctctcttaacaaactctccctcacaaaagttgtctctctaagagtccccctgaacccctgaagtgacagctgtctattgcctgacagtctgtctgaagcacctctgtctctactttctatcggcttctcttagtctactgttgctttaaatcctcggtcgaacacaccacgccacccgttttgttctctattatcatagggctgtttaaagccctaaaacagaggtcagatcagaaacataattccatcaggactcaatcagcacctcaaaggcccaccaaaccatcggatcaagcccgacatctcctatagccatcagatcgcacaccacacctcagaaaatgtgggaaaaccatcttcgatccatggtggactgcgagaaaccagacgagaaatacccgactgatctatgcgacctcctgtgagcctagtccatcgtggatcgtgactcacagcgggcctgggcactcgcacgttcgttgggctggcccatacgtgcccccacgtgcgctcgcattgggcccacccctgcactagactgcgctcttctgcgtgcactcgcgcgtttgtcgggcttggctgctccactgtcagtttctgtcgatccgccgtaggccttcaccaccccatggactgtgccacctattttcgagtttctctcatgcgtatctcctccgtttggactgttcttgggctcgttggactccatttgtcatcctaagtctattccaacaccaccaagggtcagaaaatcagatgcccctgtcggccttcaccgctccgtggggtatgccacctatttttgaatttttctcgtactctatttgtcatcctggacctattccacgccatctatttttgagtttctctcgtattccatttgtcatcctggacctattccactttgtgggctgtaaactcacgtactccatttgtcatcctggacctattccactctgtgggctgtgccatttattttcgagtttttctcatactccatttgttatcctggacctattccagcaccaccgagggccagaagatcatatgcccctgtcggccgtttttctcatactccatttatcatcctgggcctatttcagcaccactgagggtcagaagatcagatgcccctgtcggccttcaccgttctgtgggctgcgtatctccttcatcttccaacccccgtatcttgatatttaatccgtgctttcgtgattcaaacctgggttacttggatggaagaaaaggcccgttccattaaactaacaccacggtggcaggtaattgaggcctttgagtaagcactacggttattaaagtaagtctaagattctgaccagcctgcatcacctttttccatggatatgaatgatgtgaatcaccaaaagccaatttatattccacggtgatcggcaaaaggcatcagattccttggcgattatggtggaagatgattgttccgattgtagtgcattcctttccgtcctttcagctgccgacatcttatagacaatataaaaccaaaaaaaagaaaaaagccacttctttatggttatttaactgttggccgaacatgagcatgactattgaaagcttgctatctttctgagaatttgacgggaaactaacttactttttttttttttaatgctattctaaaatttttgtcaataaattgactcatgaactcgaagcaacaagttttaatatttaatttttgctccgaaaaaaaaaaggaattttatgcaatgagtcctaatatttcttagcatgccagtcttttcaaagaacaattttagttgctgcttaatggttctctttatgacagaattaatagagactgttctattttttccctgttcatagcccaaagctaatccttattatgattttgcttttgactgattgtactgggattcaattcattctttgacctctcctagaacggctccatagccaaaatattatatcctcaattatggttaatattagttcctagacatagattcctgtttctatggtttgagatttgtatattcttagccatgacatgtgcaatgctggtaatttcaaggtccatccatcatgctcagatgatcaacaagcaattctgatggctacgaatctcggaggtcgacctactcctccaacaaccacaatttgattgactcgactatgaaatctatatttgagatagcctatccatcaccgatgccgaaattattacacttacaccagggcctttttcttaatttggcttccacttttttattggcttggctctccatcctctctgctatagccttgtcttaaagatcctcatatccatctttctttatgtcaagttagtgtcggtatgcaataatgacaggattaatgtgacaaaacactggattagttaaatccccttggtccatctctgtccctgccatctttgacaatgtcttttcctttggattccacttctgaagatgcatcaactccattctaaggaagtttgttgtaatttcagaattccatccatcataactttaagcgcagtttgcgttcgcccgttgtttccacttgaaatatttcctcctccttatgatttgatgagaccacctttcctctcatatgataaccgattggcatgctccaatggatgttagacacatcgttgggtcgaggagaacatgaagaagtatggaatctgcaagcattattgtttaataggctcattagggcctaatctccttcccctccctcaaattcttgccaatgatgtaaggtgtgatgaaagatgagtatcattttccactaaacaaaagaagtgggcgataattgaaggttggggggagacatagcaacactttcactcagacaaagggtggggtagtaaatgtgttaacaaacgctttagaaccattgaaagttctgctggcttcttaaagtcaattgccatcatatttttgggcctccaccaacattattttcatggagaaaaagagaaatctctttttcttcattcttacttctcatgtgacattaacccattagactaactaattctcggaataacatctcgaaatgcttgagcgtgcaacatgcaatgataagtaggcagtgggagccccgtaagggagcttggtgttgcaagtcatggttctactgccactttatagaccgccgtcaaattatagaaagatgagaacgaattgcatacataattatcgcattttgttacacggtctatgaaagatttttcatcgcattcaacaaagagatcgatgcgtgctcagctttgtgtaagcatgatttatatctctgcttgcttaattatttcacatgagcccatgcaatatgccatgtgccaagtaattaaaatctcgaagaaatagttcttaagggaccatcactcacataaagtattggaccaagttctctcataatgtggagatcatgtgctgctgccattatccatttacgatcgaggaggctaccagcttggattaaggcttaggctggagtatcatcatcaagtgacggttgctctttcttgtcaattagctgtcttctttaaggctagtattattgtggagctcaagaaagttggttagggacaatgaactgaactagctagctagcactgcccattatagaatgcaccgttgcaaagctgctgctatttcttccctagcctcctcttcttttccttcaaagaatcaatttgattacaattttgtaatgctttgaaatcaagccaccaaatgcttatcacaaccatcagaaatacatgcatttgaaaagccccttgatttctttaccttccaaattttgaatttagctccttttattttggtgacaaaactaacttgctcggttgtgttgattattaatggacaagtgagctagtgactcaatccatttcgcatagtttccatgttaaacctcttgtccgagtgaccatggtgaacacctcataaagacagaaggacacatgaaaagtgcctttgtcgtgcggtctaaataagaaaaggttcgtatgaagatcaactctgaagttcaattataaatatcaacgtcctccttaggtttatcttctccaaactgccaaattaatcagaaaatcctccatgttataggctactcaagaccgatccaagatggccttaaatgattgaaataacctaagggactcagttctacatggtgtggaacacaataatatcgatcagcctttaagttttccatagattattttcagatttaggaatcactgggcatgattatctctatacgatgggtgcatgtatttttaccctctatttggtacagaggatggatcggaggaaggatggatgaggaattcatttgtttggtgaaatatgaaagaatgtatgaaaataattttctcttctatttaatataaaaaaataaaagaaaggacaaacaatatttgtatgacattcttaaagatccatcctttggtaaaacaatattgttcttatcaatttataatatttatttatactaaagaagtaagtaatgtataaacttataatattcataatttataattacacaaaaaaattataaaaatttaatttaatttaataaataatttaataaatttaataaattaatttatttatatatcaattatataaataaataaataatctataatttaatttaaatagtgaattaattttatacaactatttaattaaaaatagtaaatataaataaaaaatgaaagataattctaattatttaatcatagttatggaaatgatatacagaaattaaagataaataaaaaatataaataatatgaatgaaaaagtgaagaaatgttatagttttattaaaaaaattaatgaggataattttatcaatactcgtctcatatgctccatctatctttcttagattctctcaattttggaagatgtaaattgatggaccagaatggataggcaattcctcttttttcatccatcattcctaaatttttttgaactaaatagtaaatggagaccatccatctttacaatcccattcatcttccctcttataaccttaactagacatggatgcaccgatttgatttgtaaatcataggagcttctcgatcttctttttttagacccaattaaacttaatcatatgagatcaaacatctcaaagttaagtcacaagtttttttgtttgccaacttcctggtgtcacatgtttagaagtacactcctaagtctgctctcaattgagtaggcacagatatggaaagatagtgttaatgtggcttgaattttggatattttttatgggctcgaactatgacccgatccgaaaagcccgcgttgcgatctgaatgctattttttgggagatctgtgatggtagcggagggcatgggccgataggcccatgtccgaagcccaccactgacctcattgggggtgcggggggaacgccccccgcgatatggaccagtataaatattgtactttctgccaatctcggcagttttatgagagaggtttgaaaaatcaaattgcggctagggtttggagagttctgagtgattgtatctctcttttcatcatagtgaaatttttctctcgtgtcttgcctgtggacgtaggcttttcagtcgaaccacgtaaatcctgtgtttgttttttcttctcttctctatttttgtataattgtacgaatctgtatgtgccctatatttgtacttgctgtaacagatagaatacacaaattataaattatgtagaacaatagaatcattcagtattagatatcaaaagtattggttattttgaatattttggtgatccattttccaagcagtaattagctcagaatttttatgagaattaaaggtgaggcaaaaagtcatagaagccggttaaaagattagagaggtccttccttcccctccatgataaccaatatattcagttatacttgcaaaaatagctaaaagaaaagaaaagcaaaaaaaaaaaaagcacagcaaatatatccttcggaacatggtgtaaattattttagtatgaaaatatataacaataataaaatgaatatattagttcagctaagttaccatgggcatcatgatggaactaatctaccaaaagtgatcttttaaatcttcacgagttctcttatcaagaaatttacatttatgaatactcactctgttaccattaaggtggcatcccagtggaacgggtttttatttttaacgacgtgattcagattcgaatcacgacggatatcggactgtgattaaataccaagatgcgaatgactattgaatggagcatatcctgacggctcggacatggcgtctggaaacagcatctggtccattagctctcgatgaatcaaacattctttagtggaagttgggaccctataatcaccttcaggggaggtagatgcaccaggtcgccctcctccaactcccgtttcgaaaaaaaaaaggaacgctcactttattcaactttcaggaattttataataaaaaattttattttgttttctttcctttattttttaaaaagttagtttaaacacattatattccaacattatgacatgtgtaccaatgttgttttgcatgcatggactattatagcatgagatatatggagatgtttatttgggagttagcaaaaacagcaatgataatagtagtagtggctcatttttcttcaaaaaagtattaaaaatatttttttaaaaaatataaataaacaacaagatttgttaacttataccctaatccgtctttcaaagataggccttgcaaatcctgtggtccgttttttgtaaagagagcaaaaggcaaattctttgtgtaccgtaggtggtgtagaaaatccgacgtggagcgcatcgtcttatctgattgatctacgtaacaccgctttctaatacatatttaatacctgctgattgattttttcgtttaaaaattttgtattatgaaaatacttttattctttgataaaattatgatattccatatctatattatgacatcctgcattcagcaagtcataattttttatccataggatattataacatgcacagaatatcataatttttttaaaaataaaatatttttgttattcaaaaatttttaaacgaaaaaatcaatctgcagatattaaatgcgtattgaaaaatatttgaataaaaatactccttccatattatgatattttggaccatattatgacatattagattataatatgtcatagaatatcataattaaaaaaaataaaaaaaatttatataaatttttaaataaaaaaattaatataaaaatattaaatatatgttaaaaaataataacaacataaatcaatcgaagcccggattttatacactgccggcggtgcacggaatttctcgagagtaaaatgatcccggctaaacaaaatgcgttgccttcacggggcccaccgccctggcgctgacttcggtacccctcctcccgaccgtacgattcgctcctccaaagagatatcagatccgggacacgtatcacttaataagagagccaaactaaaggcaacagtgagagggacccgccgctgccagcgcaccactcgcaggcggccacctcgcgggggtgtcgcaatccggaagcggacgtactcggcgggacccaacccgctgatccagctgtctgataacgagtaggaccccccccaccccccagcgtccttcttgcagtcacacgtgttggtccggtgctgaggtcgctttcagaaaagagtagtaggggtatcccgcgggaaagccgagggggccgatccgtagagagccgtcggcatatgattgaaggccgttatgagtcctcttctctggggcccaccgtggtgggtcccacggcccacagtcaatttcctgggcccggagtggattcgcttttccacacgtgcctttctcacgcgtgcatctgctttttaagatttcctttctttgagtgtggctctatgtgtaccgtttgataaatacatacgtttcaaaaaagagggtttattacaccaataagcatagagggcttctaatcctacacccaattctagagagaagatatcctgtaccgcatatcacatgtaccatacatcatgtcaatcattttatcttgatcgtatgactgtatgcactcatcttgataattgatccacgtgaagaagatgaattctttagtatattgcatgattataatggtgcacgtggtataggatattattttgctctattctataccgttgatctattttttttttatgaaatcgaaaaaataattaaggtgaaaaaggagaagctgtgtttatagaaaattaaattgctaattacatcttcatcatgcttgcatggtgcaaatgaatggactcgatgtcaacgagaagagcgacgaaggttggattggtaggggagatgatgtataatataacatattgaattggctggaaaatgattggataaaagtgcatgcggcttggcaacatatttttatctttgtatttgtcttaaaggtcattttccctcatttctttttcggagagagcaccctcaagggacatggtgtgcatgatttgtcggcagattttagtgtggaaaaaaagggaggtagccattggagtagcctgatagagagcaggtagcatatcctgagatcacaagacaaggagtggtgtcacacatcagttgaaaagatgagaaccatcaaaagtagctttaggtcaaagcagtctcgttaattttgtccaaatgggatttgacaagattaggagagcccaaagtcttcatggggacgccggtgatagagagcgcaatgcaaaggaaaccagcttttgttacccaactttgtgaaatcctatgtgctgtatttttttcatcatcatgcctaataactgtcacggaaatgacacaaaagaaatgatgaggaggtgaaaatatatagtgattgattagccatgatctggtccttgaagcatttctctcttataatcaaaagctatttaatggcggccatgctcataaattctttaattacataatatcatttgcacacaatgcgagtagcaaatcccctacaaccaaagccatcggaatcttctgcaagatatcgacgcgggagtgcagcaatcgtgaagagcagaaagttgcaacttttttttacctcccagtaaacatgcattcatatacctgctaataaaaattaacagaccgatgatttatgcttaatatttgattgctgtttgatcgatgttttttttttttccttctaattaattttttggtcgtcgatgatcatctatccgggaaaaaaaaaggccttctagaaaattggtaattgatgaagttaaagataaccaaatacagaaaattttattaactaggtatatagaccataatagagtgtctaatcacaattagtgcggttaggaacagagccttaattttctgcagccaaatgctacacaccaaatgctacacaacaactaattttattaagaggatatcgttcaaaaaatgatgcttatcaaagattgattatgtggaaagcaacatgctataaccaataattgtgcacatcgccggcactgttaaatacgatcgagaccgggcgaggcaagatttcgagtcacgaccattggaggagccatggacgctggttttctgtggtaatggggaaggtctgaggtttttggaggggaagggtgagggacataataatggtccacctatggtaaatgggcaatggaccaagtgcgtatgtgtgtcctccgtaagccctacgccttgcaatttcatgaaattattgatgaccctttccaccttatcctcacgtattgttgtgagccttgtactttgatttgaagggacggggccacattctctctcgtggctattcccgcgggaccctcttgcgtcctgtgggagaaaggcccttcccctgcagcacgagagcattggctgtggccttcgtacgtatcatattgagggtgtattattgggttgacccaccgtactttaatgcacatgtacgtagttccaaccccattattttttttttaacatattcttggttgctcatgtagagtatagttttttcatacccacaatagacgatggggcattcacgagattccttttggcattattcacaaacgtgtggcaattcatgcacaagagtcctagccttgaaagagggagagggtccatttgtagggcagtgcaacgtaatggagtctggaggtcacaccttcccatccctatcttccgtttatatgatcctcaagcgataaggtctggggcacaccatgctcacaagttttaatggtgggtagaggactaattaactctctcatgcacgcagctccagcaatgacgcatgacacatagcagcagtgttatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatattacctgcgagtttggacaaatttaaacaggcagcgtggtaaatgcattatatatttatatatatggttgacctggaaacaagatcatgtgcttgcatatgataagggccaatgcatgatgatgattaattactttaattctttgaacactgggcggcatcatatgcttttgatcgattattgaaatctatctgtgaataataacatgctggcactagcctacatcgccatggccaagggaagccacataattaattcgcaaacaaggtgatcgatggagctaggtacatcaatgtcccaaggaaggaatataatacccttcatggagtttcgcaaaaagctatcgctgtggagtgtcatgtggaagatgcctctacgtgcctggttcgttgtcctggtctcatgcatatcttaattgcatggagaatctgcctttctgaatgacattttaattattctggtcatcctcctcctatgtgtacttacgtcctaaaagccatcgcatatatatatatatatatatatattccataattttttccttttctaaattttatcccagttttgggctctcgtaaagtctgcttgacttgattacagagcaccgagttaaaaataaataaataaactgtagttccacagcacatatatgatcattaatttcagagtattcataaagcaaaaatgatcaatctcatgctcgtccccccaccttcgaagatggattggatagtttctatagcagacctacaaaacacgcactcaaaaatgtatccaccatcccacttagggcaacttttggtaccacaccccctttagacaaagacacttggatggaaaatgacgttgttttcatagttttgagtggtctcttccgtcttttagcgtccgcagcaaattttgaaggaccttgcaacatatacatacgttgcatagttgtcatataataattcaggctaaacaatgatttctctgaattcagctcatgcaccataacatatgggatagaaacattaataaaaggtaaaaaggaatgatgctatatatatatatatatacataaaagggtgtgataccttttagctatcaagtgtgcaaaatgaatgtttattcagggagtgtattctccccccccccccaccttttctcaaataaaaaggaaaatgcatgcgctgagttggcattttatctgtaaagtgagcacatactattcaaaactctcatcaatagttttggaagctgctggtatcttcacaaataatggagtaagacgaagcagaagaaacatggaaatggaccttttggtcattgcaacgaatggtgggagacttttctctttgttctccgtcggtggggaagtgcgagaacaatattcccataagctcagagggtcccgcttttgtttggatgaagatacctttgtttttgtcttcgcgcgtttccactatgtatcaaagaaaggcccagcaatcctttaaaatccacaagttattgagccacacaaataattcatgacattgagaatgccaccaaaattgaagtcttggtggatactaaatgagaaaacaattcaacattaggctttcaagtcttgttaattaacaagaactgacacgtttcttgcccgggccttctctttctgacttgggatataactaattaataatttgatgaccgacaatggctatggtgcttattgatcttagcgtttagactatgatggcattaggctgaaataatactggggagcttactttttcacatcatctattaaaaaaaaggagagtgcacaatagattagcatgcaatttgtgaccccttgcgtgaccatgcatgattgtggcatgatcagttgatctttgtatatagattgaatgacaatacatgcatttcaaacactagctaggacggatgacagacactagactcaaaacactaggatgcttattttatttatttattttttgtacatcatcagctgaaaattttaaggatatattcacacctcggcatggcatgcatatgcatttgtgaccttcgacatgaccttgaatgtgaagccggccagttgatatttgggtacggattaagaagacaattcagttgaagcaccaatggtaacactagactaggatgccacattttctacatcatgaactggaaattcttaaggttttacacctcgtttggcaggcaattgtgaccccagacattgactttgatggtggcacctgttgatttgtgggtagatattaggaagatcgacgactcggttcaaacacaacaacgacgccagattgaaacactgggatgctacttttttatgtcattgactataaaatttaggactgcactccttatattggtatgcagttttcaatacttgtcccatgcaagatttgtcatgctaatctttaattcatccttaattaattaattgagattgcaattcagctcaaacaccaggatgacactcctgcaatttttttttttttcctataaattcttcagtgttaaaaataaatcgtatttaagttagaatatataaaattttcacatttataatttgagggttacacgtaatgacatgcagatgacaagcaaaatatttgtacccctttataccagctgcaaccagcgagttaactctttgtcctagttacctgaagtgtactaattttattaaagagacctagtatatataatatctagagatgtcggccaaatccctagaagaggctttgatataacatgattatagcctagaaaaggcaagaaggagatatgcaatatactattaactaattcttctcggtttcatgcacaccatagcttagtcacaaagctgatcaccaatatatgaatagcttctgtgtattgcatcttaaatttttcaacaaacatggactacttggcctagctggcacattggttcattaaactctttcaaaaatgtgatgatttggataaagttatggtgataaatatgtatcaacatggcgatcaacacatgtactgcgaattaggtctcagtaagcctacaacaaaactaccatgtggcataattatctaaaaaatgcatctgtcaatggggtaagaggagactggaatatcctcaataatcacaaatgcattaataagctatttcgagcacattgcgttagccaaaacatccgaacagagcttaggaaattgccctaattaatgttttcactgttgcttgtgccggtggatacaaggtcatatgtaacacgggttttataattatataagatcattgagacttaaaagacaatgtcaataagaatacgatgcgatcaacatcctgacgggcttgtgctgatatgggcaaaatacattcagcattgtcccttggagagattaaaccttcacaagtgacgtacgttggcaatcaggtcaattaccatgccagcagcatatattacgcttgaatcatgcaccaagcttctcaaatcacagtggcaagatgtgacacctaaactttcaagttcctcattgtgaaaccaggagatgatgaaatagtaacctaaaattcagcttccatagaggctatctgcagaaatcttgttgcaatattccccccccccaacccccagcttccctttcatatgaaagggactcatctatatatatacgaccacagaacgtcactaatttgtgaaactgttaagttgggcttcaattagctagtactgttgttgattgaagtcgaccatggcatgtttgcagtgtttctgggctcgtcggatgctatttcacatcatatatggggacgcaagactctgcgtgttgcttcatcagcagaacgattgctactagcaataaccgccagtaagttttaatttcttgagctcatagccaactagctccatccaggaactgtatcaattcagttggacaaagacctgacaatctctctctttcttcttctcaaagttgggtagtttgcactcaaccaagacaataaagtccacggcatcggtaccatgtacagcacctcagtctagagagaatggacccccagggtttactttatatgctgtctattttttccctatatatgcctatacagttagttcgttctataattcttttattgactgcagtagttctacgggggatgcataatacgtgcttaattaatttcagtctttgagaactgatacttgcatactgcaatccggccatgtttttgagaatgcatggtgatatataattgacttccaatccttaattgctcctttcagcttgaccatatatattactactttaggaattaaaattcaccccgaccttgctagacatcacacaggagctagctgtgacgagttatcttccacgagtactgcaaagtactactacttacgttccacaactgccgacttataactatttttccaatattcccctactacctgagtggttatgcttcacacttgctgctgctagtatctcgatctaccaagttctcagcaacaaaatgggtcactcttatatatattttattctttctcaccaccatcatgagaattttgtgcatttaaaagttgtcctcaccatccatcttcagggaatgggttccacacgacgctagccaatcagagccagctatccttaagcctgtcttaatggcccatgtggccacgtttatcgcccataattcaagtgagagattaattaacaagtatagggctagctagctagctagctagctctctctcgaaatttctgggggactacatatctgccaacgatttttacgaccaaagactagatattttcttccatatgattcccatttattttcttgatattatcccctgattcccaaatggccatataaataaataaataaatatttacaagttagttttcggcgaaattgttgggtggtaaagacggtgcggggacctttctgcatgaactcactgaccgacgtcacctcaccaacttcacgtcatggtcaaagtgccaaaagggcatttcagtaaaataccactcctcggttgggactctaccgtcattttatcgcccccaaaaaaaaaggcaagaagaaagtaataaaaaaaagtggactcgttgttggttggctgaggtcccatcgattccaacatttggaccacagccgggtgcacgatttgcgctgatctaattaccgtccgactcgaggaccgacgggtggatgttggatggtggggccacccattattgaatccaccaatcagaaccgtctgataggtggtcctcatccaactgggcccaggggaccacaaccaattggctcgctataatcatggatcaaccatgagcgccagatcacgatcgccgtttgtacgatacatccaccatgaggcccattgggtttgtacagatatgatcgatgtgacatggatggttacagtcactcgcaagtaaactgccaatagaacagcaccacatggtgcattcttggttttctgctcaaaacaataacattaatttttgtaaaattcttatgtaattcttggatgggatggaacacccacatcgtcgaaaagggagcgtatctactactttcaggcttgaaaaataaaaatcatatatcccaaccgaagatccatcgcattcatcatgatttaaaatatattgaaaatatgtattaatcaaaaatcatttgttttcaaggtatccaatatgtgcagcgagtgagcagacaagaaatagatgatttttactatattaatgcactaaaacataagataaaatatttaattttattaaaatatgcgtagattaaaaatcaacagatttcaatatttagatgataataaaatatattctcatacaatcttaaccgctcaattttctgtctacttaactaatatatgggttagaagctgccaaacaaatgattttaaatttttaaatatttttaatagtataaattatgatcagcgatgtgaatctttgatttagatgtctgattattaactttaaacccaagagaaacaaagttcacctcttgttatattatttgtatgcagactagagatattctatggctgatagctaatgttaaataacaatatcaaataaagtttatcataattttcacgtggcatgtatctgttctatattggttcatgggttgctcaaatctagtttttcttcttctttttttttcctaatttatactcatattctattttgaaattttttcatggttaacggtcggtcgaatgctgaagggcccatctcatttgctggaaacaggaaggatctgaggggtcctatatatgcaacagcaaccacagacagagaaaatggccagaatctattagtattatgatattcttatcattattaattcccatccttcttttaatcaagaattacgtaggatcacatgcactcaatcatgaaactgtactcttctaatcatttatgaggaaataaaattaaaacgccaacatactgtgtatatctctgactattttattctaatgtcctccacctcccatggacacttgatgatttggtatatactggtgctagaaaatttcttaatttcacttcaacttgtaccatatgatcagggctaggcaaacatcaagctgaatggcattagatagagagacacaacttggtctttttcttcagggcaaaaaaaaaaaaaaggccatatgcataaactatttccggcattttgagccatcccactcgtgcaaataaagcctaaaatagactttccattgcactgtattaagcttacggtccactgtattactgttgcatcacatatacaagaaatcattagaatttaagcagctatgcagaactgtataagcaccaattagcattttcggaagctacagaacaaaaatgtctcattcacgtttaatgtatggagtgatactacttgaagtttttcttatggaattgaaggtgttatagcaaaaaaaaaaaaaaggatttagtataagacgtataaaatttatattttgagattattcagtaacgattactgctggagtgatactacttgaagtttttcttatggaattgaaggtgttatagcaaaaaaacaaaacaaaaaaaaggatttagtacaagacgaataaaatttatattttgagattattcagtaacggttactgctgctagagcattcaatggctgtatcaaagatgtgaactagttccacgggtaagtttcaccgtcccgaacaaaaagcaagagaaggatcaaattctcccaaatggaagaatgccaaattctcagggaagttttcgagtttttcaacatgaagaatgatgcccatttgttctgtattaaagatatagtatgccgttctttccaaacaatgatgaaactttccgaagtgaccagagatttgggaatttacccaaaaagcaaaaaagggaccctgctcccactgacacagtatcatgtgggaattcggatgggtatcttattttctagctttcttaagcaacataaaagtatactactatattagcaaaactccctcaactaatcataggtatttcctgccacgacaaaactttccgacccaaatctgtggttgctcctgggacaagttcttggggataaagggtggctagaaaaggtaaggttggattgcttcgagtccaatacaaaagagagcaacgggagagatatagttcggagacaaagcctttcctgaaacgtgcgtttgttaccttgttacttttaccggctgggtcctcgaagctaattggagatgaaagccctggtagttatctcgattaggatatcggagcgagtgccccaccgtgggtgctccagagacattaattccgggaaggggatgagacatttgcagctcggatgaataaatctccccctttctccccaccttcaaaagaaggggaggaggaaaagagagcaaaaaagttgggaagaaaacctctcaactcgatcccacccactcgaccgtgacccctcccgctctcctttaagatcagcccctttcctcttagctccattccttctccactgctgcctggatcgatcaccatcccttaatttccttgacattctcctggggatcgacgatcgatcgagcaggagtgatacccaagcctccctccctccctcggaccgcatttctcgggctggaaaatggggaggcattcctgctgctacaagcagaagctgaggaaaggcttgtggtctcccgaggaggacgagaagctcctgaagcatataactaaatatggccatggatgttggagttcggtccctaaacaggcaggtaaagtggcaccacacttgccatactcccacataaagtagctgcaatgcatgtccgacgacatgaccaaaataactagacatgtatctctctctctctctcttgatttttctcacaaatccaacacaattcaggccttcagaggtgtgggaagagctgcagacttaggtggataaactacctgaggcctgatctcaagaggggcacattctcacaggaggaggaggacctcataattgagctccatgccgtcctaggaaacaggtacacaaccccagaatctctccctctctctctctctctctctctctgttcgtttggtctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagaatactctcctcctctctctctctctctctctctgtcttttgggcttttcatggtaccactactgactactgagttctgacatgtcgtgtttcccaacacattctttctgtttctcctcttttctttccgcattcggcaggtggtcgcaaattgcagcgcaattgccagggaggaccgacaacgagatcaagaacttctggaactcctgcattaagaagaagctgaggcagagaggcatcgaccccaccacccacaagccgctcgccgacacccaggcccgggacgacaaactccctcccaacggcggccagaatattaattctggagccgatgacctcagcggcctcccctcccctgctgctctcgatccttccatacccaagcccgctcgatctttgatgctcacggtggataagttcgccccagagagctcgaacccgaagaattcggcggtgggcgctcaggaattccttctggaccggttcgtcgccagccaggagagcacctcaagctgccacccatccaattcgctcggctttttccctcttccacagttgagttatgcctccgactgtggcggcaatcagacggcttcggtcgggctctccgtgacccccaatccacttctctggtttaatcagagcagccggctgttcgattcgagtcctgaattcagttgcagcaccatatccactctagtcccatctgcctccgcctcgactctctccacttggatgggcttgaagtctgtcatcggtctcccaccggataatcctccaccgagctgtgccggtctcaccggcatttccaactactgggaggctgctaattgtagcaacagcagtgggagcagtggggggaacaccagtagtggaatcgaactgcagagcaatagctcctacttcgaaagtggaatcttcccatggccggacctgacgccggataaagacgctccggtccagctccaaggggagcctgaggacctgaaatggtcggagtacctccatggcgccttcccggtttccgccgcaatccagaatcagagccaacctctatacggcgacatcaaaacagaaagccgagtcgcggtcgatggcttcggtacttgttacccgaatcggcaggcacagcagcaacagcaagcttcggacatgtacggcaaggatttccagagagtatctgtggcttttgaacagatttagattgcgcgaagattggtacagcggagaaagagagagagagaccgaaagccatcccatgaacagaattttcgacttcagaaggctcgagtaataaaaaagacttcttttaaatttttacaggtgtgtgcgccatagatttttgtcttgtaaataggtctgatgatacaaagaattcagcagctcttcagctttgaatatttgggcagactgagtgggactagctaggtgcagaataaagcttgtttcagtgtttttccttcttttcttttttttttcttttcttttctttctgtccctgttttcctttgcaaattcacaaatccaaattatctattgtaaacaatcaaaatctctactttttgtttgtccgggtcatcttccgctctcctttctttactgcagatatcatatcaaactaacacatcggaaggtaataccctcattttgtgcatgtcagcagttcttctctgagattgaaaatggtttcgacttttccagcagtcaacatgcacttccacgaaggctaccttatactgtatatgttcccaccaagactcgatgtataccgcaatcaacctctcgttcactcatttgatggctactccaataaattctttctacttcatggggaaggatttggaggcaagggactgagaagcttgttgattcttaccgtcagaaaaggcaagaccatcgccttccctccaatgggaaaagcaaaccatctattcaagagacggataaggatctatagagtctacccaatagcagaaagaaagtgaccctcgaacccatatcgatcgtaagccatgtgatccggtcacctttacctccaggcattattttaagcccactttaatctggaaagctagaagcttgcaaatcaagagaaattaagcacgacacccatgtctatgtttaaatcggaataagatggcatagattgcttctttattctggtagttgtcttccccgaactagtgtattgcttggctatgctattggagcagggggggtgttaccatccaccacttgagcttgtgagggaattgctgcgggcacatcaaattgtgcgtgtgggcgcacgcacatgtgcatgcgttcgtgtgtgtttgagccccttggatgggctcctcttgatgctgatacttttcagggcagggagtgggaagggtataaaagtttttctcttgatgtggatgtgttcgctagccacatgatcaagtgctgagaaaaagcataaagaagaaaagaatttaaaaggtggagagagtgggtctattccttcctaaaagcatccggctcctgtaggctcattccacattcccaatattcttgctctctctctctctctctccaacaacatgccatgccatcataagttagaacgaactgaacatggcagacctgataaggatgggccagcacgtatttaagaactttcttacgaatattgatcaaaatgaacaaagtgacatgagatgaaacaagggaccgaaaacattgacttaggatcatgagcagacagaaattaattcagctcaatgaaacaagtactggagatatgtaacgttttcacctcgatgaaatttcaccgactacatgatagcatctaaaatattcaacatcttgcgagcgttgagtccagcaggggatggcatgaggaacaagcatggcatgttctacagcatggacaaaccgatgtcccccattaatttattatggccctcatgtctgttagaaatgcatgtgagctgtatggtaagatgcttttgcttgagctggaggaaatcatcgcttaaagaaggggacggaaccctcgagaaacagaggctgaacaagaggattagacacaaaaatggtccataaaatttcatctttatgcgccaccatagcaattatggaggcctgtatgacggcctttccaagtagggaagctgaggaccccacagcattgacgttccacaacgtcagcaatttttgtcctgcaaatcgacatgatctcgagcagagcattttagcaaatcttattgaaatacatctatgatacgtgtgaggggagcataattgtttgccaagtgcctcattatccaatgtaccgcacactatatgtgattcagtttatgtgcatgtactgaaaatgtttataaaagaaattaaagtaccaaccaggcagaagtcggtcaagtggccatgtccaaacctatataacagatgaacgcaggcaaatccttctcctttgtagaaaactgcccatactgcaatgtatctatcttctccttttatctggacaggttctattttgtattaaaatcatcaatatggtctgtaatagaagcctacctggtgtattgaatcctctgtccttctctcttatttttgagagagacagagagagagatagggaagagagacccagcattataattatccaagtctaaatgctcgaggtatttgttttttgagggaataaatgctcgacgtatcgacctctttatattggcagctatacagcagctcccgggtgttttaacttctaagtttatcttctccttttgtagcaaactgccgagactgcaatttatgcatcttctccttttatccggacaggttctattctgtattaaaatcatcagtatggtctatgatagaagcctgcctggtgcatttaatcctccgtccttccctttgatttttgagagagagagagagagagagagagaggagggagggagggaggagagacccggcactataattatccaagtctaaatgctccaagtaccgatctctatgtatttacagccgatcgttcaatcaatctttgactctgactctacatcgatcttacgaatataatatttcgactaacaatcagttaatcaatcgacaatcgattattatcaaccaacaacggacaaccatgacgattcagttaatatccaactgaagatcatcgatatatcagagtcaccatccgatgctcattcggacctccacgactatcgatctactactattactgacatataatcgacttaactttccacgatcacataaaatcggaatatgcggaacctaaccattataaacggttatcgactatgtgtcacgatcattagtgggcataaacagcctatgaactccacgattatggtccgataatttagtacaataaaaaagtgagaccacgtactcgatggttacacctgaatcatctataaaggaaggtaattgaacagtattggtaaaacaattttgggtcgagactctgtcatttcaaaattctaatctgctgttcaccactcccaactgacttaagcatcgaaggatctccgtcggatacaatttcggtcagtgagaacttcttttgcaggtgtttttctctgacgatgggcgcaacaggagattgaccacaacagattggcgcgtcaggaagaaaaaaaggatataaacaaccatgtcaaaaatcaaaatccagcattcaacaggttcagcgaggtagtctttccatcggaaagatattcctcccccacttccagtggtagagtccagttctttgcatcctatggtcactacagatacgcaaattgctgcacttatgtagcaaatgaaagtattaatggaggcggtccaaagcctccagcagtagcaaactcagtagcagcagcaacagctaccggtggaggagctggtagctcagacagtgccatctaggcacaatcgccgtccaccatggtattcaccctcctcttcttcagagcggcgatcgtctcgacactctcactgagacgagtagccatgttctcgacactcccatcgtgccacccatcattcgtgacgttcttcctctccttctcatgcatatagtatcaggaagaggaaaagatcgtggacaccttctgcttctccatcttcaagctcttcaagaggttgacccctagagtttctcagcaacagcggcttgacgactatgaatgtaagttcaagaagattgaccaccgacttgcccgactttaggtggaaggttgaaaatcctccaacgactatgacttccacactatctagcctctctctcagcgcatcttagataaaccgattctgtctcgattcaagaagccacagatggagccatacgatggctccaccgacccgatcgatcatttgaagagctataaggctctcacgataatccaagaggcaaccgacgtcctcttatacattggctttccgataattattcagaagactgctcgagcctggtattctagacttcaaccagggagcattaactcctttgagcagctcgaataatctttcatgatccacttcagcaccagtcgaaagctgtcacagatatcagacagtcttttctctatcaagcaaggtgagacagagacgttgagggattttatggctcgatttaatacggccacacttgaggtgagagatctcaataaaatatggccatatcgaccatgaagaggggtctgaggggatcaagatttacctactctctagacatgactctccttcggatctatgatgaacttctagagcgtgcgtacaaataattcgcgcggatgaagctgcttctgaccgacgccagatagacgaaaaaggtcagaagaagaaatagaagaagagtgaaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaaatgcttacagaagcatgaggagaaagtaaccagagtgttcggtcaaatggccacgctcaaacctacataacagatgagcactggcaaattctcaccccatactcaatcgcctagactacaactgcttatcttaatcttcttcttgtgtctctatatactttatttcatattgtatcgtcagtttgtttctgcaacaaaagcctacctggtcccctgagaaatgcaactacatttcaggcaaaacggagtttttaacttcatctactttctagtttgtagggctgatatctctatattgagtgcctctgaatcacatctgagaagttctttgtttagatgtctgcatccttctctttgatcgctcgttagtaacatcaatgatgtataacttggaaaaagaaaaagcaagagaaaaaacttcagacgtaaattcagaccatagcccactcaggaggcttatcaattaggtgccactgttaaaggttttcataggaaggcaaaacagagaatcaattaccgttaatgcctccatgcatcataaactcggttaccaacccaacatgcattgttcaagcaataagggatatggcaaagactattgtcttatgcaagtacatatttgattaaaaaagttaaaataggacttggatattgggagagcaagaaaagagaacaaaccacagcaataatacaaggaataggccaagatcttatattccacgaaaaggaagacaaattctcatgaatgcaaaaggacaagaaaatgcaatgaaaacaagcaagcatcaaggaagcagaagccaatacaagaagcagaagccaaagtctcagtctgagaggagagggggggggggggggggggaatttactcaagcatcaaggatctttgtaatatatatgcgaggaaagtttccccaagcattaggccatctattttgggaaattccataggttgtgggcatcaatactgactcctctgctgacttcgcagatttgttcacattcctgccaaaattacttacaattttcatggaatgaaattccttgacatcataattaccagccaatctctcccagcttgcccaaacatggcatccacataaacataagcgcaacacagttgttgaaacctgcagttgactcaaattatgctccctttacccaaaaaaaagaagaagaagaagaagaaacgacttccacgaaatgaattttcattcaactcaacaatagtgaataccaaaacaaacggttctgatgaatttaaagaacacactgaaatggttgtcactgttcaaacatggtgggcagtcctgagagatcaaactcagcaataaataccacattcctgaaaatttggtccggtaaaccttgtaacaaatggattcatgcgaacccacagcaaagagaatattgcagcaagcagaagtgaccaaactatgacaactgttggcattcggtgctggcggacaaccaagcccttcaagaatgggtacaaatggatgatcaccaaggatgagaggaacagcttggcaaacagtaggccccaagacccatatccactattaatagcagaagagatcccagagaccatagcacataaattaatgagaattattgtcgttggggatatcaatagagaagtccatctgaaagtgcacagctccctgagatcattttcaacagatttttctgtcaacacagtcaaattagttttcttccccattaaaatcttcattggtccataaataattgcaaacaagtgtgaggaaagccctccaatcacccagagctgctggcttctccaccactcctgggtcccaacactgctccacctcatttcaagaaaaccagtggcaataattgagaagaagagaagtgtgagagagatgcttccaatatcaccaatctgcaattttgaagtataataataatcgttgtcacaggatttataacatgcgtgacattcaaaacaaacacttcccaaaatttcctttttgattttttcttggttcataaagaaaaattattgagcagttgaagcttttttttcctcgattcatgcaacatacctgtggaacaataaattttccggtgataaggcagacagctggtagagtgcagtatataacaagaggaatggatgtgatggggtaaatggtagcgttgatgtaagctattctttcaaataacctaagcttgccaccgtatgcataccataccgggcaatgccggcttagaaggatctcaactgagccaatggcccactgaagtaactgatttaaacggtcagagaggctgattggcatgattgccttaaaagcaggaaggaatggcatgcaatatattgacctccatcctcgggcatgcatcttaaggcccgttaggatatctgaagctaaagagccatacatccaaccaatctgagcacaacaaggataatttagcacagagaaaaattaactaatgcatattcaaacttcattctttaaagatcccttgcttcccatcggccactatctagccgaacatatgcattgataaataggtttttcttttttcttttttcttttttcttttcttcaaattatcagaaatttatagacatacagattcataacatacacccagaataacagaacatacaaaaggtaagaattcatagcagattatggggatcaattatggtacaacaagcaattacctctcttccccaagctgtattctcttcataatcacagcttattacatgaattgcttcttttaggagatcttcacgtgttgcagatgttgagaatctatcatccttgacaattatcgaagcaataagagttggtgactgaccaaaatacttcttcaagctcagcaaaggagaaggattttccatttcacgactgcttggttccatgttatatatacctaagtcgtttgattccagatgtatggtaggggcataaacacagccatcagcaaagtctttctttcctggtctaccccagctaaatctgcaacatttgggttctaaaggtgggtcataaccatacaaagctttcctgttaaagaaacatccagtgcccacataaaagggcccttgtattccatcaagaccctttaagtttatctgcaaaaaataacgaggactttcacaggttatgattacaaattacaaaacaattcatgaagaaacccatctatcaaattggtttattgaaaagaagttcatcaagttgttttttctctttctcaatagctagtgacacttaaacacaattttcgcaggcgagtgccagagaattgccacaaagtggcaatcatatattacatctataccagaattacctaaagcatttatttggttaccagaaatacctcatgtatgttaataaacagattgatgcatgccaggaggggagtattatctggaacagactgcattgcccagatttggaatttgcaagcaaatgttcttgacagcaaaatgacacactatagagtagatgcaactcaaagaatgttgtgcccagataataaaacttacagtagtaactatccacacgcgcatttacctatgaaaaccgttcttaattatatagatattttcatcttttctgacaaataaagaaaaactatatagatattgatcatgaaaaatcattgaatatgtgcaactaaatactgcccaaatttctcagttcccagtgcaggtctgcaaatgcaaaattttttaatcctctaagaagtcagttacctaaatgcatatggatcaattctctttatttagtcagttctggacaagtatattggaagaatgcctgctttgattcacatactaaatgcataaatgcatcatggatgaatataacagcatacaagctttcttaaatgcaccgaatttaggatgagcatcaaacaagcaagcatatacatccagatcaagaatcaaaacatcttcatacatctgcaaaacacattcaagttctaatggttggattggctatgttatcagggttactgacataataccgaatcttgatggccttttcaagatgatatataattgggattgcatttcttaagtttgttgtgggaggaacttaaatccggtagaaagcaactgttgtttatatggatctgttgactcacatcatagaagattgtattgtggctagcatactgatcgctagtatcaatgccatcaaatctttgtggaaactgaacatagcatgccttctttgcaatattgggatccatcataaagcacatggcttctaggaaagctttgctgttgttgacatagtgattgcagttaaggtttagaatatacatcccatttgtaagaatggcagaaactcgaacctgcaggttgatcaacgggttcctaagcttttcttgatgtcatacctacaaagttacaatacctcaattgatgaaacagcacaaataatttaccagagaattcaaagctcctgccatcctgttgtgatagtaacctggatgcttttcacgggaaacataaacaagctgtggaagttctttaccctcattgtcaagaggaccaccatggcctaacagtatctaaagcaagaaactcagtgcaaaacatctcaaaaattagtacgagcatgtaaacaatgagtatatgcagcctaacatatataagcacaaaagaaaaagagagaaaaacctgtatcattcctggatgattttgagtgttatttccaggccacggactaccgtctctcatgatccaaccatcacaagggacattttgaaacttggcaactaagaaattaatttcgattttgaattcctcatattgtctctgaatacataggaagtcagagcatatgtaagttaccgtgaccacacatggttaaacaacagacagaaccttttgaaaccaaatccaaccacaatactcattctttatggcttgtctagtttcttttgatcataaacaagattttattcaagtgaagaaaggtacaaaaagggatgactacaaacaaaccaaactgacaactcaaggacatcacataatcatgcaatcatcctatgaacatctctctctgtcacttctacatgactgctaccacattagcatgatagcatccctactactaacagcagataaaaagaatctatagaggcaaaggaacacctcctcaagattgagataactgaccttttatatacatccaccaaaatgcaaaaatcaaatcaacccataccacagacttcacaaattgcaatgaccaacaaaccttccagatttaaatgatgatcaaatttcaagtttaccagagaaagtaaagccagctagttctgatgcaacaatcaccaggaaaaagatattgtttacatgaaattgtaagatcttcaaataaataagcaatattctttaccaacctaatgaaattaaataatctaaatcactgtatggggttgtcttatttcaattttttcttttaaaattttgaaaagaaaaaaaattacttcaagaaattagtcttgtttacttcatgcaatataggctatgcagatgcactcccagtcccctaaccttttcaaaagccactaaacatgttattgttctccaaaaataccaattctacacgtgttcaaacactgaagaatcatgaagccttgtaaggttaatcattggaattgatcaacagacactttggaccacaattttaggctattttttaacatagtttatgtaccctggagcataaatgataacacctccagatattcataattttttttcagtagctcaatcgttagcaaaccatgatagaagccctgatcctagaagaacattaatttcaagttatgaaaatccttacatgtacttaaaaggaggataaaattgaaggcaaaagcggtcgcatgtaggaaaaataggcaatcagaactacaagggtcattatttaacagaatatatcttttccatcaagaattattttgcaggttatcgaacaaaaaaagggccctgtaggaaccaccaactatatcacacactgatcaattaaaaatggagcactccaaacttgttcttaacaaaagatcataaaaccctcaaaatgtcaatatgctttgccatttaatggcttgcagcaggaacaagattaagagacagaatcaatgattatcaagtcagctctaaatgttggatgaccacacacaaaattcaaaaaatatgatctcaataagtaagcttatgtaccggatgtggaaaaagcttaagtacccaatctggaaaaaaaaaaaaactcaagccggcaaatcaactcctagttggtgcaacaaacttatcaaatgcaacatcaagctcagcatactcagctccattaaatggtcaaacatgcctatatgcagccaaatatatgcatagaatctctaattccttatgaattccacagaaaaacatgctgctctttgaccttgagttgtctttcttcttctttcaacatcacccacaaaattcaaaaaatatgacctaaataagtaagcaaatgtacccaatctgaaaaaaacaaccaatcctcatgaattccacagaaaatcatgctgctctttgaccttgagttgtctttctgcttctgttccacatttcctaacagttcaactcatgaagaagatacttctcagatctgatagacctctaccatgagaaatcacttagatttacagcctaaaagctacagcagaactgctcaccgaatccaaaccttctatattggtttcttcattagtcaccaacttaacatttacagttatttcacatatctgtcgattgttgtcactcacaaaatctgagctgttaagctcaaaccttggattgatttttcaaaatatctagctctcccttaggaatatatcaatttgatttgctattgaagattttccataatgaatcatgaaagacaaaatcatgtaattctttatcaatataacaatcttgaaccaaatcttatgtaatgacccaagagctcatcttaaaagactagccataatgtactatttggatttcttgatcctatataaatacccaaaatcttctcagcacaaccaatgtaggactaaacatgcactcacataggtcctcacatattttccatgtttaagccctgacattctcgcaagataagggtccacatctagtcaaattccattgcaaacatcacgtttgggccatggccaacccaaaagagcccatgctatggtgtcccctagtcacacatggattatggctggatccatctgataccatttataacaacctagaacctcatccaaaaaggttagccaaagatattatttaagttccttgatcctatataaaaattcaagatctccctatcgcacaactgatgtgggactaagcacacgctcgtatgggtcctcacatcttatttcgccaaacatcctcagctcagttgaccagcatccttatccccttacgagatatctagggttttgaacgtcatggtggcatctgttggaaattctcataaagtgacttttattgattatagaccaatttcttattctgatttgttataaaaaatatgagcgaaattgtcgtctgaatgaatggttaaagagtccataattacctacatggtattccataccgatccgaaccggctgctacaatccgtaccgaaccgaaccggcaaggaactatttcgactagaagtaaggtaatccttcattctatcactaaatattttatttttcatctttttttagccaaaaaccactaagaagtagaaaaataaggaaaaatcatgtcaaaatttatgattttggtatgatttcagtatatgttgtagatcattagatgatctacacgataacattaaaatcattaatttttattaattatttttttaaatatatatatatttaataaaaaatatttaaaaaaattaaattcaaaaaaatataaaatcaaaatattatttaggatgatttgagctattttcagcataaattttatatttgattgtgtagattttgatgcatgatatgcatagtagcttaggcttaatttcgaaaaaaataaaaagataaatagcatctaatgcatgttaataggcttagaaaaatatatgtaacatccatgacatgtttctactcggatctaacctcaaataatttttttaaaatttttaaatttaaaaatgatttttattatttaaaatataaaaaaaaattagagcataaaaaatatgtaaaagtggtaatatattttagataattcagaagtattatttgaagcacataacatatttttctgaattgatgagatttaaaattattattaaaaatttaaaaatttatatataaataaaaattatgagaaattagaattgtgaaacgtattaatcagaagtattttatgaagtttaaaaaataatttttttataatgaataattataataaatttttataattattaaactgtcgtattttgttaaacttgcaaaaatgagtaagtagtcagagcatgacattggctgggagtatggtgagatactctcagttcagcatcattggagatgtaaatagtacagcacaaagttcaaaaaaggagggatgactaggttgaagatgcatttgactggtggttatcaggatgagaccatatgtcggaaatgcccacagaaagtttgacagcttatgaagaagcactttgctgattctaaagcagcgaaggagaggacaaagcaaaagaggacagagatggatcatcaagttggagagccaccttcctatcatttcagagagacaggcctctactctagatgataaagaggcatagattaaggctgccattcagacaagtctggatgatcagtacagactggaggagatggccaaatatagagagcgatttgaactttatactggtgtgatcagtacagattggaggtccaactctgcgaccaccgaggagagtctgagttcaggaggaccacctctatcaaggagccagtcagaagaggcagacatagtatttcatcgatgctgggggcttttgtcagtaggaaatccgacagaaatattccaacaagagccaccattcatgatttgaatccacatgctttttctagcaaggattcaaaacaacatagagttgatactatgctgaagaaggataagaaaaaggatatgtgacgagctattgaatcatagtttcattttaaccacattccagcaaatgcaatggacaaaacttactatcggtctgccatgtcgccatacaaactgccagccccaatgtagatctcccagcatccagggatatctatggtcaggttcttgacagtaataaagaagattcaaaaagatgaatttttttttataagaataaatggctcatatacagactgacggtgatgtgtgatcgttgaaccgatcctactaaatgaagtatcataaattttttgatatattgtgatgaaaaatattttttcacaaatcaattgatacttcagatagggtgcacgacgccacctacatctttggactgatgaaggagatgattgattcagttggagagcagaatatcgtgtaggtcatcacagataatggaccgcaatataaggccgtcaacgagttgctgatggagcggcgatcgcatatttattggacatcatgtgctgcacattgcattgacctcgtgttgatgaatattgagaagcttcgtaaagtgcaacagacagtggatacagcccagtctattactaaatttatctacaatcatatatgggtactatcattgatgcaaaaaaatattgagggagagatcttgagaccggatgtcacacggtttgctacaaactatatagcacttgataaccttctacagaagaaagcagccttgcatcagatgtttgtcagtgccgagtgagaagagagcagatatgcgagggccggtactgagggaagtcatgtgaagaacttggtgatcagtcagttattctagcaatgggctgataagatagtgaaggttatcaagccattatataaggtgcttcgcaccgcagacagcgagagatacccccagatggacttcttgtatcatatgatggagagaataaagaaacagattaataagataaagctcaaatatgtctaggaatacatcaacattattgagcactgctgggactatcagatggatagaaatttgcatctagccggtaaacatgaattcaagaatcatctgaaaatttttcttttcttgtattagtataagtttacttaatcatttgtaaaatttattttcagcttactatttgaatccgaagttccaatacagcatattcgggatagatatggataatgagcttctcactgctctccgtaatatgatatataaaatggtgtccgattctgaaattgcatatatgtgtctacaagaggtatgttaggtcaattaagatgcgagtatttaacttaataatatatttattaataaaataaatatatttttcacagacgaaacagtttagagagaggacagacagctttggagtctcattggctgtcgtaagcaaaaaaaagatgaatccaggtaaattatatatcaacagtgaagactttgttgacattacatgcctactaatatcataaaatctgatatataattttgtttaatattctggtagctaaatgatggattcattttggatagtccacacaaaatttgaaaagtatgaccatccgcattcttttccagacggtctcctctagtgggtgtgagcataattgattgactttcgtccttatccacagcaaacagagaaaccatctgacacagaagcacctcaacgatcttatttatgtacattataatttgagattgaggctaaaatgtatccagaatgaagtacagctgaagtatacggatccgacaatagataattacatcattgatgatgaggatctgatgattggatggcttgcaggcaagcagcaggagttggaacttgatgagccgggatctcctccatgaccagccagtgtggtagctagagagatcaggatggatccaggacagtgggcagatacaaatattccccataggattccagccgataagccacagtctgagggatcacaggagagccattcatcacgtgactccatgtccgagacatcctgctagatatttaagcaagaaatactgagacaaagtaggtcatctcaagcaggaagaagacatccatcctcccagatacagcaaagtcagtcacaaagggacaccaagggagctcgaaaagacaaaaagaaaagaaagccagttgcagcaccttcgagagtgcaggagtaagctgactcaaatttggagaccaacaacagtaagagtaatgatagcagtcatagatctgatgatcacagagagactggaggatacaagatcactattaatgagatgcagtcgtagaatggtatttgattcaccgatgagtcccaatttatacatgctacacaaaatagggatcacggtgcacgagctgatagaccgcatgaggagatgatttcatatagacgacggcctcccagagatcgtccaatacatgatacagctgcaaatgaccttgtacgtagagtaggatctatggatgtgtctggatcatcctcatattatgaatcctatcacccgcaggtagcctatgatccatatggatatagtgtatcctagactttgacttccagtggctactatcctatgcaatccggagcaccttatggatcgaattttgctactgatatatttggatggacccctctacagccataccatcatctcgataatatctctcagagtcagaatttgagcgagagatctgagatgtcttacaatctatagaggataccttatggaatgaatattcaggattatagtactacttgattaaagaaatggactgatgttcctctggagtatgcagatgatccagatatgtatgagtggcacaaacacttgacgagatattagatcagcaaagatcttaaggttagcatactattctttataatttgcactttagatatatttaatgcattattttagtcttttagacttcttttattttttttggatgatagaattgttatataacacaaataaatattaatttggatatgaagtaatctaaaaattaataaaaaaattttgaaatcaattcaactgaaaaaaatttatggcgtaccggttctgaaccgatatgccacaacgtaccaagcaagaactggtatgggcctcgatatcgattcttgaaaccttgattatctgcgatcatattatttggatcctattgtcttagtcatgtaatgtggcagatatcagtatagacctgactcaattaatgagctctatgatgggtggacccattagcattactaactagacaaggttcccactccattactatatatattcgcctatagagaaatcctagggcatcaagatctctacgttcttaggacggaactatcctattgaggagataggatttatgccgtcattgttgatttttcttccacaggatgttgatacagcgatcattaatggtcgcttaagaatttcaaggtacgattgattattattattattattattcttttgggatctattattgaataatttttgtgttctaattttctgcataagatccatgggaaaatattcttccataaattccctacaattggtatcggagcctcgattttgtagaggattagaatcaaaatcaatgattttataagggattagaatcaaaataaagaattaatttaattgaataaaaaaattaagaagaaaaaggatggatctctttgaggccgtcccctcttttcttcctcttcttgccagtatggaaggagtaccaatgcgtgattaagaccatccagcggtgaaaggccgacgatctcgtccggatcgtcggatccaatcaaacaaacaaacaaacaaaaaaggatacgggggccgacagctccatgtcgtgccctcttctttccacagccggccgtccagcacagcaccacctgcggtgactggcgctagttcctccccgctattccccttctatcaccaataaaaaaaaagaagagggccaatggttcccgccaccatgccctcctcctccctgccatcaccgtaggccgccatctggccgacaacaccatctgggcaggcaacggcgaccttaacaggccatggtgccgagcaccatccctcccctcccttctgtcatctttgaaagatcaaacaaaaaaaagaaaagggaatcatcagatcctagctttaccaacgatcgacggtggaggtggcaatggagagaggccaatgggaagagagccatcaaaccagtattaagcgaagaggggcgtcgattttggcccccttcttcaccgaccgatcaaatgagaaaacccactaacgggtttcagatttcaacccaaaatccgaatccaatttgctaattcaaagttataagatacattttgtattttggtccctgtagaatatcatatttgattttggtcctccaaaaattatattttagtccctgtaatgcaatttattatataaagatctctatattcctatttagtccccgataatatttatttctgataacagtcttaaaaaaattgacatttattccctaaaatgaaactttgttatacgttaaaatgttcctattacagttagtcctagttcttaagtttattgcataacattgatctaaatattatgatctctgcaatgcaatttaattacataaagagccttagcatgctattatgaatttagtactctcacatttggtttaaataatgatatattttttagttgatccctgatttagaggattgtagatttcaatagatggtgaccaccaaagtgacccattcactgagatttgcaagattcctctgttcagtatttaagaggattagacaagttatgtttcgattaatagcttgatattggtgtatcaagataaatgagtccattcatgagcatgattggttaatccatgatttagatagttgtaggttgcaatagatggtgaccaccgaagtggctcatttattaaaatttgcacagtttctctatttgatatttcatggaatcaaatatgttaatcttggattgattgcttactattggtgcattaagttggacaaatagatttatggatatggctggttgacccctaattgaagatttgtggatttcattagatagtgatcatcaaagtggcccattcactggtatttgcaagattcttctgtatgatattttaaaaggattgagaagcattgcaaaactattgcatacaatcatctccccaaagggagcttattatgtgttataattttgaagtgaaatattttatgactagtgattgtgcatagtctaggatagttatgggcactggatcgtgcctgacacggcccgaccctggcccaactggtcaggatccaaacaggcacggcctgtctggtaaagcacaacccgtttagcccgaaccctggcctggcacggccctagacccggggtttggcgggccgtgccaggcacagcacgtggcccgtcaagcctgtgggcctgataagtggcatgcgggcctgatgggcgattcttttttttctttttttctaaaaaagcaaccccaatgggccgtgcctggcacggctcgtttaagcccattacgggccgtgccagccacggcccgtttagtgcggttacaggccctaccaagcacggtccgtttaatgctgttacgggccagacacagcccgtaatggctaattcaattttttttttttgagttggataacggttagtttttatttttttagtcattttaacccccaacaatcataaaacggctaattttagagataatttgaaaaaataaaaatattaggatttctgtaaataccctcctcgtctattttcaccacaccaaatcaattctcctctccttctctactattactcttctagcaatatttagcaagtattcaatatttagcaattagcaagtgttcaagtgctacacaagaggaggattaatccacctattggagccttagaggtccttattgaggtcctgaggagcacaagaggaagccccaaatctccacctacctctattcaatttcttcatttggttaatttttattatttgtataactcatatttagatttagcatcttttgatggaggcattttgacattcctctgatttctaatggagaagaaactactgtttctgcttcctctgaaaccaatacccaaagtcaaagctcggtctcttcttcccgtaagaggattagtgctgtatgaaatgattttgaaagagttatggtagatgaagttttaaaagcaaaatataaaaaatatatcaaattatatagttgtactagtaatgaaaaaactagctatttaaaaagacatcaatagagccatataatgagtgatgctcgttttcaaagtacccttaatacataagagggtaatctcgtaggttattttgcatataatcaagaaaatcaaaagaaagtacggataaaatagatagttaagaatgaattatcttttagcttatataagtcttttaattttgaagagtatattcaattagccttacaatctacttacaaaagaaccagtaaatgtacatttagaagagtagctatgactaattttttagtaatgaaacaaaatttaattgaaactctctctgtcctaaattcaaaagtatcattaacttatgatatttggacagcatatgttgatagttattattttattactgctactgctcattatattgataatgattgactattaaataaacgtattcttgcttttcgtatttttgatttttcacattctagataataaatttctaatgctatttaccaaattgcatattcatatagtattaatgataaaattatgtctattacttttgacaatatatctaataataattctgctgttagattattgaaggactcattgtatcccattttaaatgaaaatttactgcatattagatgtgaatgccatattttaaatctctttgttcaatctgacatatggttcaagatgttattataaaaattagaaatgcagtttcttttattcatacttcaagagcaaaactttaaaaatttaagcaaatatgtatagattatggtagatgctttaaaaaatttaaatttgatgtagttactcattagaactcaatatataccatgataaattatgcatatccatataaaaaattattaagtgcatatattaatgatcgtggattaagttttacattgatcgaaaatgattggaacaaagataaaattttgaaaaaaaaatttattagtttttataataccactaatattctttctgatgtttattattcaacctcttattcatttttataacaagcatatcttattagccaaaaatttgtacaacatagatatgatgatgttttagagcttattatttataaaatggaatctaaatagaatgagtattgggataggatatgtcctatgcataacttagctactgtatttgatccacgtgttaaattaagtagtgtactaactttacttgatgtatattatgaaaacatgaattaagatcccaaacccactaaagctgaggtgaaccaacttctttatgatatttatgctttatatgatgaaaaagttagtgaatctagtgcttcttgttcacaaacctccacctcttcttctagtacttctagttcatcatctattttctcattcattgcagataggagacatacacatgcttcttcaagctcatctacatcttcatctttaaatagtgagcttaaattttatttacgaaatgatcttcaatctgcatacgatgaaaatcaaatagagtcttgatgtgttagcctaataaaaaaatattaaaaatcaatattctgtaatgtctgctattgcacgtgatatcttagttatgccgatgtccacagtagcatcgaaatctacttttagcgcagatcgacgtgttctcgatgaaaagagaagtaggatgatcgacgaaataattgaaatgctactttgcttcaaagattaattggatgccaaagtgagacttcaagataaaggtggacacgatacaacatccgatgacaatgacgacacaaacactgccgacgtatgacgatcagtaagattttcaattattagtttcttatatttgtaacattttagtttttatcttttaattattaaggtgagtcacctctattttttttctctcgctcattgtattctgaaggtcaagcctaatcttcctctctctcttgtaccattttgattattattaataaaccgatagggatccatgccaaatcccccatcattacaagatggttttttatttttacaaaaaaaatctaacatctatatttaattttgctccttaacccttttttaatttataaaaaaaattatattttttaaattcaaaaaaaaatgatcgggccagcacgcgggccatgccgggcctggactgtgccagcccaagcccttatgggccgtgccgggcttggaccgcaagccgcaaaccgtcaacccagcccagccccttttaataggttatgccaggcacaacccgttactgtagcagtgccaggcacggcccgatttgtgccaggccaggctgtgtattgggtggcccggcctgttgcccatgtctagtctagaaattcattctaccaaagtagatgaaccttcaaaagttgatgatactttgctaagttgattctactgaatgctggagagatatcttatgtggatcactttttttcaaaaaaaagtttgtggcattgcatcaagaactctcattaaaataatacttaaaaaaaaatttcaagtatatatgttacccatatttgtccattgattaactgcataaaagttgtttagcagttagcacatttgcattgaataacattacacattgaagtgaggtaccttatgtgggtcactttctttctctgaaatttatgacattgcaccaaggactctcattgaaataatgcttataaaattttttaagcacatatattgctcatatttgcctattgattaactacataaagattatttagcagttagcactctacattaagtaacattaatgctcctattaagactctgactggaataaactataaaatatggaaacgtaaatggagcaatcactatgtttgatgaaatttggatgttacattgaatgatgatcctccatcttacatcattagtgagagtactttagaatataaactgcctacgaaatatgatagaaggtgaatcattttagcctaagaatcatgaagaagtctatttttgataccattctagatgttaaacttaaaaatgatgactacaagtaattatttaacctcattagtaagaggtacatagagtctcataagacaaggactggatagctaatggataagttaatcaatatttaggtatgatggcatgatgctgttagggcttacattgtgaaactagagagtattgcacctaagtttaatagtttgagacccctatccctaatatttttcttgctcattaagctcttaactctctccttatgtaatttgatcagcttaaaatcatatacaaattgtattgttccttaaaagatagttggacaagggctaatattgagattaagaagcagcataggaagatggttgagatctgatcgtgatagtaaatttggccactaaacgggaccttttattaaatacttgtaagagtatgagatagttacttaatacaccattcttaaaactcctggacaaaatggtgtagctgaaaggcataattacacttataagaatatgattagaagcatgatgaatgggtgcaatttatcatgatatctctagagtgaggccttgaagaccactatcaatatattgagtagaattcttaataaggcagtttacaagattcttttgagttgtccgttagtaggaaatccaatactaatctttttcatgtttgggactatcctgtaaaggttaaaatgtataatctgacaatgaaagtttggactagaactaattgttgttatttaattgactatgcagataatactaaagtatatagattctactgtcctgacaagaggtataagaatagttgagtccaattatgccagatttctaaagtctaatataaatgattacagatactcttatactggagatatgacactaaagaaaaataagttattattcttattttagttgtccaaaaagatgtcatatttcatcctagaaggacagtgggagagcaacatcaaatatataaatcgattatagcaccttcataaccagttaatgaaataccagtaaagatatcattaaaaaaaaggaaaactcatcattcttaatgaccatttggtttatttagatgagaatgactatggcattgactatatggataattcagtctcttgtaaagattctttaaaagcaatcataacactgataacccgttttgacctacagcttcattagaaaaattttatataaatcaaccatgaggttttattgagagtgggaaaaaacatatggcatacagacctaaaaggtaaatctatggccttcagcagttatcgatgaaatgatatcttaagtttgatgacattaagcattctctgggatttgaagataataaggtggatatatatatattttatggtcaataggagtaaatttctcttctttgtcttattattaacattattttgttcgctattagtgattctattgtggcacgagatcaaattttgctatctaaggtctttgaaatgaaagatcttagagaaactttatttatactcagtattaagattcacatgaatagtctgtgatatattaggattgtctcaaagagctcacattgattgtttactgaatgaatttggtatgtctaattgcaaacctagagatgtacatgtggtcaagggagacaaattcagtagaaaccagtgtccttagaataatgtagaaaagaattcataagaaatgtgccctattcaactattgtgtgcagttttatatatacaaagatttgtgtcagatcagatatagcatatatgatgagtatactttacaattatataacaaattcgaacatgaagcatttggatcatagctaaaatgtcatgaggtatttataaaaaaccataacaaaatatatgtcaactcttttttttttttgaaagactgatcatcttaaggcaataagctatcgtgattttgaattttactgtttgcatggatgatatgaaatctgattttattatattttaatgatggcggaggagctatttcttaaaaaagttcaaaacactcttgtagtattttgtgctgtgctggcagagtttgtagtatgttagaagctgcaactcattctgtttggttgagggacttcatcctaggacttatcattattgatttaatctcgaaaccacttcagatttactatgattatggtgcagttatgttcttttcaaagaataataaaagttttcaacatctctatccatatagagataaaaatatttgacagtcagagattcgattaaaacggactcattgtaattgaatacatagagattgatgcaatgctaacaaacccattgaccaaaggacttaaattcactatatttattaaacatgtgaaaaacatagatctattggaaccttttgatatgtttggttagtgggatcattattttttgttgaacatcatatggatgtcataaagcttttgtttttttttcattattttcataatgaattattgcatttatatttatgcacatatggttgtttgtaaatgatgtttaaatgaaagccttaagcataaagatatcgcttaagcataaaggtgttgtttgaatagaagtcttaagcataaatgtgctgtttaagcatgaaaatattacttatgttataatgatatcgttgatatcatgattcgccttgagacataaacgactcgtcttgagcatatgatgaaattataacataagtttaaaattgttgtagcttttattggaaagcataaaagggtttcatttgaaatcgtaaagtggactgatgatgagctttgtatattttgatcacatggatataaagttcatactacatgcactacatcactagaatccatgtcgataagattactaacatttgtaaccacagaggggtctaatatcaataaatgatatgaagattgctgtgattcaatgttagtggttttaacggaccgaattttttgactaaagatgttattcattcaagatatttgcatatgtggccacatgaggtgcgcttagcctagaagtcattttcaaactatatatataataaatgtattttcttgaataataaaaaaagatcttaatcaatgttgtccaaggggagaatgttgaaaattctcataaaatggactttcattaattatagactaatttcttattctgatttgttataaaaaatacggactaagttgccatctaaatgaatggttaaggagcccataattatctatgatcatattatttgaattttattgtcttagtcatatgatatggcaaatatcggtataggcctgactcggttaataggctctatgatggatgaatccattagcattactaactgagctaggcaagatttcctataccagtaccagtgccggaccggtacagtatgatatcggtaccgtaccgtaccgacacacggtatgcatcagtgtaccggttcggtaccggtactcaggcttttttttgttttcatttttttttgtggatgttgaagttaataattgataaatacaacctcaaaatggcattaaattgcatattattgacatattttggttcaattttgagttagatagcggtacaaagactcttgatccaaaatttcaaacatatatttatttacattatatttctactatgtcatcttaaaactaaagaaaaatatataaaatatggcattaaaatgtatctaaatatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatttttggtatgatttcctcatattttcattttacctcattcttatcctatttctaacaacaaaaataaaaaaataaaatatttactaataaaataacagattatcttatctccagccaaagatcagcttctcctcgaaccactcctccaatttcacaaaattttgcccctttttttctaatttttttgaaggtctcaacgaaaccgttgagaccttcgtagcccacgggtgttctctgagaaatctcagagaacactcttcggtgtgggtgctaattaaagcaccaggcccaccccccctcccggccccccacgtgaaaaggcccactcccccctcccctccccacattttgaagtggggctgtcggtatggtttggttcaggccgaaccagcatcgaaccgaaccataccgcccgattccggacggtatgggcccaaaccatgccgaaccgggcggttcggtgcggttcggggtcgtttttcggaaaaaaggcccgaaccggaccggtaaggcatcggtccggcttggtacgcaccgtaccaggcggtttggcccggtacggcgaacgctggggctaggtacccactccactcctatataaattcgtctgtagagaaatcctagtatattaagatctctacgttcttagggcagaactatcccattgaggagacaggatctatgccgtcgttattgattttttcctccatagaatgttgatacgacgatcgttaatggccgcttagggatttcaaggtatgattgattattattatcttctttttttgggatgtattgttaaataatttttgtattctaattttctatatgagagtcatgggaaaatattcttcaatacaatccccacatcttagttcgccaaacatcctaagctcagttgactagcatccctatcctcttacgagatatctagggttttgaacatcatggtggcatctacaccgtattttttgaaatgaaaaagcatcacaccttagctcttttgtaaccacgcctcaacaaatgtaatttagtaaatcatgtgatataccttgatatgagcaatatgaagtagaggttgaccatcattgaaatgtgacatccaagtgcgaccgaaattgaagggtaaggtacaatacacacagacatgttgatcataggtactcctttggttctttaatcatctattaagacagaagtaaatgaattttgttcgttccatggataaagaaaaatattatgacttacacaattaatgtacaatttggaagtcatgcatgtatgcagcatgaacaaatacaagtatctatagttctgcattaaatatatgtggtcattaacaattatgatttgtccaatagaattatggagattaattgtgatttcacatgcaaacaaatgtatattttttccagcaggctataggctattaccataaaggtagttcagatataatgattagtaaataaacaaatataaaatcaaaaagtacagccatgaagacttagtaccttcattgtccttctttccttagcaaatgttggacatatgttgtactttagataatccaccttctgtgagaaataaaattcaggagcccttggttcaatattgaattttttacagaatggcacccatttcctagcaaactgacaggttagtgttagggcttcaaaagtcaacagtgaggccccatcatcagagacataacacgtaacactctcggctggataatccacagccaggattgagagcacagtgtttgaagtgacaaggggtggttctttcagtggatccacagtagtaacaaacacatcaatgcaggcaagctgacatggttttcctggttggttatatctgaaaagaagacgattctgcaccttatacacatagttggacagataacttagagacttaaaatagacatccagaaatacatatgcatgtacgcacgcgcgcgcgcacacacacagagagatttacctcaaacataagcgttctggatatgttatccttgtaataggttgccatttggggagctgattcaaaatccaagataaagcaaaccaggattcacaaataattgaggttaaccaaagtccatatgcattatggactggattaacaaggcgataccggaagaagaatgctaatgctacaatctgaaagatcataacaaccctatatggattaatctttgaggaggggatggacacctttctagaaagtggctgacgaagttcctcatccctggaagcagggaagaaaataacttaaaacaatatgcaggaaaaaaaatgtacaaaccattaatgaaacagtaaaaaagtaagcacttttgaatcactttataaactacctaaagagaaaaactctattaacaattcagaaagtccttcaatgtcattccatcctctgagagtatagcattgagacaatgaaaacaaatgcttcacaatatcttatatgaaaacaaagtttcaaaatatcttatatgatcaattttatctgatgcaccatcggcatttccattcttaaccggacacttgtttcatatgacttcatttgttgaaatagacttcaagactcatgttcatagggccctgcaacatttcagaaacgaatcaacatgccttgttccaaaatcgtacataacatggggatggcagtagttattttcttatgacaagtttgtagagataaggattacaagtacccacacttgtcagcactccatcatccagtcataatttagtgtttgcaataaatctaaaaactaattcaaagccaaaaaattgggcaaattgctaaagaaagtgagggataatgaaaactataatgattggatgaaaactataatgattggatctaaaaacaaacaataaaaacatgtcagttaatgcatcgacttatacaagaattataagttcaacattgaatgtttagatattcactgtatttggtgaatcattggtgcataaacacatatttggatttatacataaaatcaaggagaaatatttgacaaaagattacactaatttcagaatcatgctatagattatagaagcatgagttggaagcatcatgcatgtcattagcaattttttttttttggggggggggggggggtcattatgagacattttttctcaacatcaattgccagaatttgttaattgtcctcgtcatatattatcatgtatgaactattatcactcatttctttacttttttaaccctttagtcctttgaggataaataagggcctcttatccaccaatatacaagcaaggcaactattcatgaaaatggattacaaacagattaataaaatttttactcgtacatagaattttttttctaagaaacaaccccatttcaaaatgaattaatcattgatctagtcataatgcttaaacttattaaaataagcagaactcttatagtcacaaagaactgaaaagacaggcaaaaattgttaccaacttggacacaacattcattcgcgattacttaaaaaaaaaaatcttacgaaaaagaaattgaggagacagcaatcaaaaatatattccatattaaattttactataacttctaccaagttattgagcattgtatagcttattgtaatagtgagagttccattactttactcatataaccatgagttagacaaagtttccatggtaaatcaagaatcatcaactcagatatgaaaagtatgatacgttaaaaacttcatacctttctaactgatccctttccacttccaaaagaggactagaatcatttactttaagcaatgtctcatgccctctagttgtgcatgacatcgtctgctgagaaagcttccactgctgaagcctttccctccagaaagcagtattaaagctcattaggactgattcccgtggatattctttctcgatagctggaaatgaaacaaaggaagcacaatcatgaaacttcaaagagcagaaaggttgaaaatgaagatgtaaaggtgcatgcacaattccctgcaatttgaaggagatgaaagttttaaaactcaaaaaaatgcctaacaaagtaaatacctgaatagaatggtacaggagaaggaaggaaataatctattctcccaccccgaatgtcaaaagatggatatgagaatgtacacctctttatgaaatgagagggtagcccagtatatgcctgtcaccagcaaaaacactgcttacagactgtgatgagtccaagataatgattataatggataactattcaaatgatggaaagcaaatgcagaaagagaaaggtgaatataaatactaacctttagacccttccagataattctccttggaggaaaatctaatggaacaattgtcttgtttggatagtgtgaggcgtcattttcttgttcccatctataatttgcagcagtgtataaatctttactggatgcagggctttccaagttgcttgagtccacaatatgtttcgaattgtgttcccagctatcagcagtgcattgtagttcatcacttactattgcaggaaactctgtcccaccaatagagctcttccactttgttagattcagatttgaattatctgttaatcaaagtattggaaacatatgaatttatgaatttatgctccttatggctgaaaaagcatcagtatgtcaagctaaccggtgtgcctcttgtaggtattgctgcatttaggacatgattgattccccactttccacataaattcatagcaggtcctgcacactggatatccacactcgttgcaagcaagaggtggcctcccatcttgatgagaccctagccaacttcgacaaacttcacagaattgatcatgtattttctttctgatctggaaaaatatagcgatatactaaggccttggactaatttaccgtcaaaggggcttgactgataaagcaggaagtgctggaaagtttgtagccaattcaagtttataacagagtcatgataatgctaaagattagtaaaaataaaaaattatgtttatatgacatattgcatacataaaagatcaaatggtacatttagtactaatttgacagtacagcaaattgtttagattaagatcaagctttcagttttcatccaggattggaatcttatccagtaaactttaagaagaaacaaagtacttgataattggagaaatatcatgaaaacaattataagaattaaagtgctagtacaatattgcaccacccaaatgtattcaaagtaatggggcactttgtgctgaaagaagggaaaaaaaacaatgaacgaataagaaaaacaaatgagccactgtagtaaattatagaccagatgagagacagaaaagctctgaaaaccatctcagcttattacagtgttatcttcttgcttgcacaactgatggtagactgaaggataaataaaggtaaattggtggacatgacaagtgtaaagaccacttgcttgcaatttgttgatgacacgttagtattttgtgaggctagtgaaggttatatttatcttgcagtgttttgagctgatgattaaattaatatacatgggaaatgagagccgagttggaagttaaattgatggacatcttgaaatgtaagctagacaagtttcctgtcacccatctgagttggccattaacaacctgagggacttggaaaaactgactggttacctctagtagataaagttgaaagaaggtagcccattttaaaaggcaagttactttcagccgtggagggggaagataggcattagttgcctctgtcttagcagctatgccattgtattacttttccttttcctcagttcctagatgggtctaatgaagaatcgatagaataagaagacatttcttacagagacagagaggtgaataggggctattacttagcgagctggaagcatttgcaaagataaaaaccaaggaggactagcaatacaaagtctgcataactaattctttcttgtgaggtaaatgatgggggaaactgctttcaaatggcaaagatatatggaatccatgatccttaattcctatgacagaagggcaggattaaagagggatcctgttcatcctggacagatgcagctttttggagaggggtgcttaaaagtaaagacagtttcagctgtgttacatcctatattttgggaaatgggaggtcaacttgttttttgtttaaaagagatgcatcgaggagtagtactgatataaatgtttcctaaccttttcagtatggcagttgaccctaaagccttgtggcaactcaagttaagaaagagacgggaacattctcttgggcattatctgtcgagagaagtgttaccgaagactatgctcagaaatttgccagtccactttagataattagatacagatttctactttacccccacagcagatgaacaaagtcagatggagatggaattggaattgttgaggcttcttctctgtaaattgaaaggatgaaaacatgtatggaaggttccagctcctgggaaggtaaaatcttaacattgcaagccatcaaaagaaaagagctaagtgctggtaatcttgctaagagaattagctccattctccttcatgtttcctatgcaatgatgctacagatattgaatttcatatgtcttgtagacataaaacgacaagaagaatttggaagagttgtacggaaaagttacaatttaaaggttggcctgggtctctacttctacttgcaacatgttggttatggcaatctagtggaccatacagaaggagaggaataagaggattttcagttttccacagatagatccagaaaagatgaagaacttatgcaagaaattaccaaacaccggaaagaatggctgcatctacctcttcgaagcatgaaaaatctttgaatcatgttaagaatctttacttttcttcatgttgttttctaaatgttttctacttcatttcattatttcatgaaatgcactgatggatactccccgcctttgtatcaaagagaaaagatattccattccaaaaagctgatgaaacattaaggagacttaattatgaccaagaagtcaacactcaacaatgtaggtcagggtttcaaatatcagtactaggcttcatcttggtatgctcctgagaaggtatggtattgggataggatggtatggttgggatggcctgaaatagtcaaaaaataacataaaataaaataaaaaaaagaaatataaatatatatatatatatatatatatatatatatctaggttagtcccaaccatcccactgcagggatgcacctcagatgattgggacaggtcggaacatccaaattcaaaagagaatcagtgttccacacctgtctcaatcctgtttcctgtcagaatggtaccatggatactgtcgcttttcaataggacctaatttcttgatacctgtacgagttagagtgaatttgggacttccaaggatcagagccaagttaataagggcaagatacttgataggaagagctccaggtttgtagtcaagggcagaagcaagctaggtttatagtcaagggcagaagcaagcttgctctatctggatgctgcaaatatatacaaaagaacacaagcagtttacaacaagtccctgaaagttttgaagacaaggtggaaaaatttagctgccatgatctggtccaaaactggagatggttgtacttcatgaaattaataaattcaagcatgacctccataaggctagatggcagacaattttgcatatcaaattacaacctgtgaagtttgagattgtcaaatgaactcagaacctaatgccaatcatttgacttggtacaacatacacagccaaggttcctgtaggcaagaggagtctgaagaccaaaaccaaaagaccagttggcaggaaatatattttaatagctatttatttcaagctaatgcaacaagggagaactttaggcataaatggagtctacatgacaaagaaaagtgttcagattaagtctcagtttgcctttttggctcgtaagttatgctttggagatgaaaggcgtttcttttataagatttttgttcctttctatttctcctagagtctttccaagtctaaattaacctaacgtgattgctcctttgttctacaagaataagaacagttaatacaacagctctccttgcatgccaacaaatggacaggtttcttgccaagcccctctcgtgtatagttgccttagctaggaatttgacttccaatgcataaagggatatgaattgagagccaaatgtaaaatattctctaacttttgtctatctagtactttcatacatgtaagtatgcttgtcttcacgtagtaagttttcaagtacttctgccagtcttgcagattacatttagcttatatcaaatgagaaaaaccttacaaagtgtagtagtacatgcacattccagtctacgtttagactacattaatgatcctgccagattatctttgtaatttaccatgtgtagggcttcataccacatttcattccaccaatcatgtagtccagcataaaattctatgaactggccgagtttcctactgatcagttatgcttgcgtgaactgatgtgtttggacaagccacttagacaacagaacgccaagaacttttcaagatttagtggagacaaaagaaaaagggaaagaaaagaaaagattccacctttcatccctcaatcggaacaaagtcttgcagagccacagaaaaagcgaatctttcccaacaatagggaaatccaatcacggtaaaagttaaaggaggctaaatgcagcatgttaccataaaccccattgcctcaaaggacaacgctgtaagagatgattcaaggtaaacaaggtcgatacgttctctcaccggtttctccatcagacggaggtagccttcgctagactatagtctgtgtcctcttcttcgtttcccccgttcccttggagatggcctcgagaaggtagcaaggaggacggcgtggagggtgggggtgctggcagaagaatggaaagaggaatgggaagagaaacaagacccggtcctggggacaggaatgcggagctccatggggtttgggaaggggggagtggcgagcgctcgcgagagagagagagagagagagagagagagagagagagaatagagcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaatcatgaatgatttgatccgagaaagatcatggccactttgatccgagaaagatcatgaatatttcgatccgagaaagatcacagaaatcgatccgaataaaagatcgtcgcatgatcctggtagtccaaagtcaaagccaaaaagaaaaggatttaagatgatgtgataatagaagaaaatagaaagataagatatgaaacaatcattgaataaaattatttcacttattaatatattataatgtatctcttttgataaaacagataatctataaatatttgcagtattctggacagtgaacatcgatttttatgtgttattgcttatctttattttcatattatattattatattcatgtgatatgagaattcttactgggctgtaaagctcacaccccttcatctttcttttcttctcagagttacaggatacttatgattggctgtggcctggatttacgggtgagcagaagaataaataagagtgttatagtatctgatcagagaattgaagaaatttaaattgtaattacgcaagattttatgaattattgttgaaataaattattatggttgataaggttgtaatgatttaatttggccttgcatattctttagggcttgctctaaggagtgtgcggccatcatatatccgatccggatgttgggttcgaggcatgacagaaaaaatattatattttaaaataaaaattaaaaaaaataagagtgctccaccctctccgagacccaaaaccccagtcctgaatgctccattctctctcaaaattttagccgctccaccctagtgtccaatgctcttgctgcctatgcaccacccctcctctccactctcaagctatatagcccccctctaggaggacattggccaaacacctaattatttcttaagcatcggatttactactcaagcactgaattattgtcgctatagggaccaaattccatgagaattccctctagggtggatctatcaaatcttatgactcaatactattattcaaaaaaattgatagtgtttctgtctagtagaatccaagtttccataatatttttaatatattgcctgaagaaattgatagtatttctcacaagtagaatctaagtttccataatatccattcaatactatggctcaaagaaattgatagtatttttagctagtaaaatccaagtttccataatattcagatctatgtaaaactgatcaatatcttctccactaccaaagatgtgggtaaaagagagatttttaaccaaaataatattatttttaaaataatttaccaaactaatgttctttcaaaagtatttacaaaaatactgtcgaaggcaaagtcaccctatgataggatgactttctgtactgactcagtacgtccaacgtcacattgagtagacgcattggacaacaaaaattgccttatgataaggtgacttatagaatcatcttaaaataggatgactctatgagttgctctctcatagaacgacttaacgtaacttagacaaaaaaaaaacccaacctccctcttcctcgttgcgagaacccccggtccccagcagccctccatcctcctctctgtccacccccctcttcctccctggctcgagaactctcggatccccagcgacccaccctcctcctctcaacctgccccacctctccctcctcctcccgatgcgagaaccctccccgatccccgacagccctctctcctctaagaaattttaagatatttaccaaaacttaactgaccgaggagggttctcgcatcagggaagaagagggagcgtccaacaccagattgggcagacgcattggacaataaaaattgtcttataataggaaacttatagagtcatcttaagataagatgactctatgaatcgccctctcatagagtgatttaacatgacttagcccaaaaaaaaaacaacctccctttttcttaatgcgagaactctcgatccctagcggtcctccctcctcctctcggtgcgagaaccctccctgatctctgacagctctctctccttcaagaaattttaagatatttaccaaaacttaactgaccgaggagagttctcgcgtcagggaagaaaaggggaggggggaaggccgagaagaggagggagggccgtcagagaccgggagttctcacattgagaaagagggaggttgttttttttttttttagctaagtcatgttaagtcgctctatgagagggcgattcatagagtcgtcctatcttaagacgactctataagttaccttagtataaggcgatttttattgtccaacgcatccgcctaatctggcattagacgtgctaagtcagcacagaaaatcatcctatcatagagcgactttgtctccgacagtattttagtaaatatttttgaaagaacattattttgataaattattttaaaaataatattatttttgtaaaaaatcagtaaaagaaaggaacaaaaaaataaggataaaataaaagtacatgagcttggagttaaagagaaagtttgcaatgctcacccttgttaggagggagagtggagcattccagatagaaggcttcgaaataagtggagcattatttttatttttttttaatatgagatggaacattctatccatatggcaggattggcaataggcttgatctatagccaagctggcagactgggtctatctttttcaaataatagacttcatgtgaatgccttctaagtaagaaagaatggcctatcatagatccatgcattttataggaactttttgtattattcatgagcttggattatttgttagacctgagaatatatttaggtttaaaattaagaaaagctggccttgatttgtttgttgtggcatgtttggaggaggaaaagtatctatgtggagattaggaggttgtcttttgttggagtatttggatcaaagatgatgtccaaaatatgttatttggattctttaacctgcataagtatctaagattaaatacacagtgcatagctgatattgactagacatacctccgcataggttcatatacttttttttcctttaaaagctttgtatccttactgaaagatattatttaaattcttgatcctctataaatattcaagatctatccagtatatgtctaatgtaagactaaatacatatgtgcacatgtcctcacagcttctatatatatatatatagtgttaaggatagatggatttgttttgtctttatatcttggtagggaggaaagaatagaaaaaaaaaatgggagagaaaatattaactttcttttgattgaaagtttttttataaaagaaaagaaaaaaaaaggagagaaatgaagagaatataaatcctctcaaatctgtaacttttttctcttccaaatcaaaaggaattagaaagaaaggaattaatagttagtgaattttttataattcccatcttacccgtttaataataaagattaaaattaatattacatttcaatcctaaagcttattttaaacctcctaactaagtctctcatcctattgaactcctgtggatggaaaaaaatcaacaataacaaaaggaaagatagaaaaaattgaaagataagatcttttcttgatttttttcttggatttattaggttttttttcaaaaatataatagtaaaagaaggttgtaatatttactttcttttcctttcctttttactttcaatcaataaacaaaaaaatatttttttttctttctttaaacttccaatcaaaaaaaaaaaaatactttctttcttttcttctctcctaactaatattttctttccttttcttttcttttccaaactcccaaccaagacgttagtgcccatgcggtaagttatgggggaaaaaaaaaacaagtattggttgtggtaaggaaccaagaaagtaattctttcttatagcggaggtagtttttaagactgagtgagactcttttcaagttagaagaatgcagaagaggacttgccatcgtggaagtgagcctctcgtgcattcaggttcatctcgggttatatatatatagtcttgttctctttaatggggtttgatagattcagcgagcgtgtgcaagtgcatgctagaggaaggctagggttgtgaggtctgatagttaccatgcatgcaacgaaggcaagcgaccttaaatcaatagctatatatatatcattaatttatatacgaagggagagtaataccttgaattgaacttggagttttagatgtcccctctggtgcaagcccttcttcctcgtcgagcttaggtggtaactgaggtgacgggcattctcacggcgggtccacatatatttatagtagagcataaaccaacttcccccctcgccaaggattctcccactttctaaaaaacaggttccgttctttaataagaagcaacagctagcacccagaagggcctcttctcacattgtaataaattagtcataccatctacgccggctgaattcatatgggaaggttacctccccttgttccattagccaaaaagaagaagaaaaaaaaaaaagacgccatgggatttgacttcttattctgatcttccttgagtagtcttttcattatttttttcactttgataatatgttgtagttaagctgggaatttcgaaatactttctcatcagattgaagattctgttttagttaactcttgtaaattatttttcagtaggcctattagataagcagtcctacaggaaactgtttagcgaacaccaaaggttttctgctactccatgttgcaggagatgaatctaaattaattctaaaaaaaaaaaatagtgcaatacattaatagagcagtaattaaatgtgtaaataatggatgacacttttaattagaatctatacacatcagcattatgtaagtttacggcaccccatttccacccttcacgccgccccttccataagatgcgtaaggggcctagaattaagctccctcacatggaaaagaggtgctaccatccgattattatatacccattcactgtatctactaaaagaactaattggttcacctagatcttctaaacaaagactaacccggcacgagagcaaggcaatttaaacatataaagacctacgggcacagaaattagggtaggataacaaggttgtgctagtatgctgctttgaaggccggctgtgcgacacaatgcaactttataattgttgtttcatttggcttaggtgcaaggatgaattgaaatgaataaggtaggacttgtgtcaacaagtgaactgcaattagaaagtaatgttgagatgggtggaaagcagctttgcaatacgaaaagaatggtctgcaagactgtaactggctatgaggagggcagacaggttaacttgctctcattcagatagcccataactagtgattaattaataggcactgcatatggatgcttatgtattgagaaccaagaaaggagaaacaacgagcgagcgaaatcacccagaatcttggtaacaaacccaagagcctaaacttacatattttacgtaatataaacacgtaacatgtatagactaataatgtggaccaatttaagcttgggtggagcccctataaacctggacccagcccaggatagctttggaataaggcatccaggcccagtctgaccaatagcccttcgacaaaagcatcacatttgcttgtgcagtggccttgcatctttctttctttctttctttgttcactgggaaaggtcctcgcatgggtttcctatgaattgcgcgcccaatccttctatctcataccaacgtatgtggtttgatgccgttccatacgcaagaatccatttccaggccttgacatagggtgaagcagaagactactctcttttagccgtgtggtccacagccttccttgcaaggatgctgtgtcttcatgctagtgtcgcttccacatcccattaagtcgccgtcgatgattgctacataacccatggcaaccacatgatcactgtatctcgtggaatgactggtgatccaaattcactctgtagctctccagcctttcatgttgacaccttgagctccaatagtatcagccgcgttttcttcgctcgtaaggttctttcctgaccgatgcaagagaagcaattggaataacttttccttttcccctcttcttctttcatttttttttttttttttccctttatttttcatgtcgtactagatgacgagcataggctaattgactctcacaacgagggtatatagcctcatcaaaattaccatagaacattctaaataacatccattcggactttgctaggagcatgacaccttcaaataagcggaagctggtagatttgcagcggcaaacgtagccgaacattcaaacaggttggtaattaatgccagagttatcacccctaaagttgactcaattaggacatttctgctgttatgatttggacttgaacctggatgacttaaaaacgacgtagatatgaatttgatgggctgacagacccactttaaattactatccagcatgtatcgggttctcttgtcaactctccttagatgcttcatgtatcttaggcgcattttataaccctacggatttgatttaatcgtctagcaccaaagtctcggagtgagaaaaatatcaactatgggacaataaatccaatttagatctgctctagtcttagcatttaaatgccaccatatgagtcaatctttcaaatccccggcttctcaaactcagtttactcataataataataataataataatagtaacaacaacaacaacaacaacaatctaacaaaaaatctaatgatgaagtccgacattaagtgatctagatacaatcgaacctggatgtgattaataaattgatctcatatgaatccaaatctttttctttttgtttcctttttgatttggagatcatcatgatcctatctttctctttgatgtactaaataaataccgtctacctacattaattaggcaacatttttatcaaactatgcttgctcaagtatgctcatagcttgtctctctcaatcatgacttgtcttgtcacgccccaaacccagcacctgagttgggcacgagacatggccacacaaccctagagcaatgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttgttgggccgtctgggctacaggcccaagtaactgggccgttacatgtctaacgaagcatggacatggtcaatcatggagtgtatgcctcaaaccttgcaactagacaatagatatatggaccatataagctagagagtccttttgggatctacatccaagtggaaggctttgattgacaaatcaaaatattcttaaggaattatatatccacatattaactatcaagtaagagctcatcatatcaataatcacaagaaacgacatggatttatattttagaaatctctaatgattctttcccttgcaatatcataaatggtattagcaagcttatacaaatagagagagtattctgtcgtcattttatggattatttcttctttcaacctctttaaccttagttgtacgatatacctataaccaagtatatgctaaattttataaacaatcccgtgccatttaatagcagctaattgtatacttatcatcattgactgatattgtggctgcacttgattggttgcctgttggtcactcgttacttaagtgtacaaatccatcacgtatggaaacattaatatataacggtgtgaacatcagcatttcttttcttgatttttcatcattcggatgcctaattttctatcatgatcaactctaaatggatagagaagccaatgaatccctgcttacacactacttggatggtaatggatctgcgggctgctctcagctaatcgaatgaaaacggtcaacacggaggagtcacacccagtcaatctccaaccagacatacatacgccatccttgctggggccccgccaccttggccaaccggagtccacgtggtggatgcatatttgtcgcggatccttcgcgttggccattctggaagatggtttggtaggcagtaagtaaccgttccacgcaataatttatggcgtttggccgacattaaggttaaggtcactgtgccacgttcccagaggacggtttgaaattttctcatgtcggtctaccgtagactatctattagatattatatattgttcataatttcgtgggggatatcctcgagtggtttggttgtaccgtcgaatccatgattcctcgttttttcctcttgcttggatgatctaacccatgacttgatgtggcaagctccagtcattacaagtgtcttggaggattactctctctatccattgttccttaaataatcacgtgtacggattgatgaaggccacatgttaggtggtgggcctcctcgtaatctaaaaaatttggatggttagaaaggattttcaatgttccatatgttgttttggcattgtttccatctatttcattgtcgatcgtcttctttattaaaaaatttcgagcattcctagaaatgagctccagtgggctagcagggaggttttcgtgttattcttaatattatcacgatcttttcttttgtggtatctgattgactatcacaatcaataagccaatcagctggctggttatctttcaaagcgtttgaaagaaatgcagtataccaaaaccgacacctgaacaataagaaaagaaagaaaaaataaagaccgacactatatgaagatatattattatacttattattatgaccttaaggtacatgactgagcaatgtccttgtgtgctagaattcaaaggagcagagaaattaaaaagatcaattggttatcttgccaatcaatttaagaggcagttcttgaagatgcttccggattttcagtaacttttatttcctatttttatcaaaaaaaataaaaaatcttttattttctaagcgtggaagaaatttaacatgacttttatgtcataactagaggcacatagcaacgatcttgaaagaaagcaaactaatacaaaacgatcaaccaatgaaaatcaattgatttatttacaatgatggctcagcattctgttcatttatccatcaaatgccacgaatctaggtttttaaattaatggatcacgccctttttaaggtatctttttaccgttcgtgttgatgtaacccccaatccacctcttttgttccatctccaacgcgcaaaatatctaaaactagctctcagcaaacgcgagcgcgtgattctatggggtccacagagagtctgacatggaaacggaatggtgcacgtgttcggtggacatgacagcacgtcctgtcccaactttctcaacatagtaattataaattctaaatttaaaataggattccggggacgcggcttccttatctccacgtcacacttttgtcgagcccctcgcctggtgatcatcaaaccgcgtggagatcagacggcggccgagccatccgacgcggagatcgggcggtctggaaaggggccgtcgacccgaatgaggtgacgcgtccgcgccgggtgccggagactcctcgcccccgcataaggacccaacctcgacggacctttccacgtgcgccacgtgtacagatatggtggggcccaccacaggaacaggttgttccgcgcggtcgcccgcctcgcccttgtcgccttccggttcggcgtttaccgcgcgctgacggcgtcgcagaggaaaccacacggggatttatcttgccggatccgcaccatccatttgtccattgggtgatgcaagggtggtacatgatattgtgtggagcgcaccaaaagtccagggcgagtggatttaatatgggaaaagggcgtgcttgttcaaggatggaaataggtttgcacaattcacacatacccccttttcctttaaaaattttcaaagtaatcctccgtatttccaatatgttacaaaatgatcccgctgttcatctcgttaataatgatagcatgtgaccttcacaagatatgataaatctttggaccaaaatgctctaattatcagttgtttggacaacatttcctacggccaccagttcatgaacgtcttccacatcattcaccttttaaactataagcttatggacaattccatttctcctatatcaagcactcctaaaagagagaaaaaaaaaaaaaagcaatctccatataatttgagaaacaacatctaccattgtttcaatctttgagaagcagcgcctttcaatttgacgcataccaattatctatgggggcataaacggtctaaataagtacatcaaaataaaattttgtatgcaagaccatcatggaaagttttcttgtggctcggagcttccacgctatcattccttaagtgccgatgcatgttaggttgacaactgtatcaattcagggaagcacccaactttggaactagaactcaaattttctgcttttctagtacaccatcccacataatatagatctctaaatttaagatataatatatatagtcatgctattgaaagatatagcccacaataacatgaaaccaataatcataatctcaaataaaataaaaaatataaattcatcatttattaaataattgaataaatattggttcagagcagttaaatctaaatttaaatattaatatacataacctcaaaatttagaaagtcaccaactacaaaattggtagtcaattaaagaacttgaattatactataaaattaccaaacagtctgcattatttttcatttttcaaggacctaattcatttaaaaaaagaaaagaaatataccaaaagaggtgaagtacacaagaattaataagtaaaacttacactattttgttgaatcaagtatcaaattttttataaataatacatcttttaaagaaaataaaaattatcgtaaaaaatataatttatagtatagcatgataaaacaagtaataaagccaatcacgcatatacaaatcatcaatatttcattgacatgattccaagtttatattgcaaatacaatcataaattattctttgtatttagtcacatcattatttagtgcattgctcatgaatattcatgttagattaatttatactagtgataggatcatatttcataatcgataaaatatgatatttcatataccaactttatacccattggctggccatatttcatattaaaccaatttcggaatccaatctttcccaattctagaggatagaaatagctatttaaaaaactttaaaaccttcatatcttttcttaaaatatatacataagtagaaaaggtaataaatgacatcataaaattcgtatttcataaaattctcagagcttgtcctcgtctatgctcaatgagaagcgattaaattaagccctatatacacacacataccatctagaaatgttaaacaaatttttaaaaaacatgaaaaaagagatgagaacttggatcaagaatttggagggggaggtggttatccagttggtgttagggttttggagggaagcagaaggattcttcctaacagctggcggaccaagcagtggtacagtaaccctatggaggagaagaatttgttagtggcggagccaggttacttgatgataacggctattcgacgagagcggaggtaggaagcaggacggtttctgaagagggtgagggtattttagtctttttgaaatggtgttggctggttgacggataataggatcggatggaaatattttgagaaatgtaaagggttattctgaaaatttgtaaagataagagggtaggcgtgagaatcgctaaaatgtaaagggtgaaactataattttattttattttattttatttcattttgcttggagtatatcgcgtcttgcactgggcaacagattccgcgaagcggctttgggaactcacgtggtaacatctaaacctttattttcttttcttttaattatggtggttgcctgcctgcttcactcgtaaaatcacgttccatccaacaaccgctattccgtagagcataaaaacaattttttttaaaaaaaagataaaataaaatattttttagataaagggatcatcagataaggatggaaagattcagctatttgggtatgaaggaaaaaccaaagctacttttcactgcggcagttccaaaaatattcagaatgaagagcatatcttgaagatagcaaaattaaagtaacctcaaactaaccaaaaccagcagcatgattaaagcaccggcaacagttaatcgactagggatacaagatatataattcagtgataagtaataaggtagactaatcaaaacggtctaacatactaaatgaatccaaatatatagtaaaatatgtatggatggtggagcagtagtgcacgtgagctctcaatgtcgcggagatttacagagttttataagaacttttcggggaactattgtagcatagtgtacaattgtacatatggttattaagattatatccatagacagtaaaagttttgttctttaatgtttgacaaaatgatactactaacttaaatttttaatgtcagttgagaatcattcatttgtttgctggtgtggattttcttctaaaggactgcatgtcattctcataattttggtaaatttaattaatagtcgaggaatccaattagttttcatttagttgcagaacatgcgaaatattccgttaattactttaaatgtaaggaattgtgaaagccatgttgtgttttcgccgccactgcacactccacggccacaggacgttctgtttccattagattattattgtatatttattaaataatttaatagcttaccgatatccaaaagggcattatagtaagtttacaccaccagaccaatcattatatacgcattccattccaagtccaacccactgcacgtcttctcagctcccaccgaaagaaaatattctcacattccgctcctcatcttcttctctgtttccgagcgctctttgaaaaccaattactaatggcttcggatgtgaccatgatggccgccccagatttcgtcaaagatgatgatgatgattacggcggcgtccttcgtttcatgccggacggcggcgacgacgacgacatcgggtataggcggatctcccgcctctcgatagagagctcggacggcaatgacgcggacgccgaggtatcggaggacgagaaggtggtgatgaggacgagcatgctggcgtcgctgatggaagaggagggggaggactccgacaaggactgggcgtcgctgccggggacgcctcgccggggaaggccggggcgggcggagaaggagtacgcgagcgagacggaggcgcggggtcggcggggtgggtgtggtggcggggggaggaggcggaggagggcgagggagcggtggctggaccggtcgtgggagatgaagaagaggatggcgggggagggggcggcggcggaggcggaggggatggaggtcggggagtgcagggtttgggtgcggccgagaggtggggtggggacgttgtgtatggacatggaagaggtgaaggcgtgccgggatctggggctggagctgcccagtgattggacggtcgagatcccgtgcgccctctccggatcggcgctggataccagcagcggcggcaattcccccatagctaactggaggatctccagcccaggtaagagcgagaagccccccatattctctctccagtctctctacagtgttgttttctgtttgccaccactaggactgctactattaccaccagtcgtgttctctgttgcaagaatttgatggacggtgatggagtgaggtgctgtcgaattactgtggaccgcagattgggtcgttaggggattaactgtgtacggcagagtggatcggacatggaaagacgggaagggcgtttagggaacccaatgatttcttgcatatgattgcacgagctaaagtagatcatgcttcaacactaagatttgatggggcctgaccacgatgatgaggatgacaagtggcagcgatcacgggattgtgatatttggcgatgatggtatggatagtctgcgaggatggattgttgcaaaccagagctagagtgacgacataaccatatattataccgctttaaagcgcacttaaaatttcgctggaactctgcaaagttgggagtttgtgtagcatggcacttattgaaacaaaaattagcatagggataaaaatgatgatgcgtaagaaatatatagtttaatcaaattttggaggtgtaatcttgcattgctaaatgtggcattgctatgttttcttctttgaagcaggcgatgacccgagggatgtgaaggctaggctcaaggtttgggctcaagcggtggcactcgcatctgcttctcgtctcagcagctgactcactcctacaaactggattcatatatatgttttcagtgttttgatgcactcggttttgagcattggattgcagatccgatctttctggctttcttatgtaaattcctttcttagcttcagcattccgtgtgggtttcccttcttcttcttcttctgtagataatgtggtggactattcgatgaaactaggaatagatagggggggaggagagagagagagtatagattatagcagggtgatttggtgattttccacatagctcactgacaaggctccaacccaagtagttgctacgttcggccattcaagcaacacgggatttcaagctgtggaaggagtggcatcctgggaggtgtatgacgagatagaggctcttgaaactaattctgcactgacactagcgatgagatattttgacctcgcgcccaggacagatcaagtacctttgtatcagcctttcgactcatatgtaattgataaaaaaaagatttttcaggataccgctctggtgctcagtctattgcctattcatttgcacacatgattgccatcaatgcgaaagtagtaccatataatggcagaaatctcgtgaaaaagatacagtggctgtttaactttttgattggtcaattcactgctctgtacttgtctagccttttgattggtcaatcaactgatgtatcgtatatgtttttttttttttgatgaaaactgatgtattgtttgttgtcgagtaccaacaagcagccttttgatgggtcaattagctgacgaattgcatcaagaaacatttaccaaacaagatgaagttttcaatgacacatctccatgtccatttgagaacggcgcagaagcattgaaccagctgtgaaggttcttcatgtataataaacaccattgttagctgttactttatatgtgtctctaagtttcttgagcatgtggttttctaggagttattttctttgggtcttattttgctattatgctaggaaaatgtaaagcttccgataatgaacctggaacactgaaaatgcccaccatatgacagctgaccggtgaaattagttttggacgattagaaaggaggggtaaaagtaaaacaatctccaaaaaaccaaaaaacaccatgcacctgtctgtttttgaaagaccagaaataaatagtagatgctttaatatatttctaagctcaaatctgttgagttctacaaagatacaattggcatatgctataatgatatctttcggatttctttgccttccatgaacatgtggaagaatcatttattggatgaatgcagaatccaacacaagttaatttcattgctggactctgggttacagcaagcaagaaacttacagacctctgtattcttttctgttggctcatgtctagttattatttcacctaaataagaatacgcaatgcttcaagattatgaggaatcatcaatggtaattcagtgccttctcctgaatatcagattgtggcaagtcctgtcacaagggaatgggcagtccattgactttatgctggatcgatcaaagtaccagtcaccaacagctgttgcaattctctgcacggtaacaggaaaattatgatagtggaatgatgaatgttctatcaattatatgaataaatggataatggatggaacaatgattttattgatggttagccaccaagagatgaatgtagagacaaccagcattctagagaattcgaaagttcattggtaacaaacagtcaaagcaaatctggtggtagtactggcttgatctacagaaacatccattctcgcactgtcatgataatgcccctttcttgatcaatggcttcatggactttatgatggaatacaggttttatgagttttatggaatattcagatgaccattttatctttcagctttctgaacccatttttcaaaggagaattgcagaaacagtgaattagaatgcaagttctttgatggcctgcgcagatcaaattcagtcatatttttaagaaatttaaataaacaaactgtttcagttggaaatttttctcggtatagcttacaagagtacctatggagaccacaaccagatgaccaaagatctcctgctgagagtaaactctaagtttggatctattggtctgattgtcatgtgaaaattattcagaaaacttaagggaaaagtaagaactcaaaagttaaaaatgtgataatcagatgacacgtcatgtaacatatgtctataaatgaaacttgtgcttacaacatgttcagtgaaaagcaaaaacaaacagtgactagtgtttttttttaaatgcaagaaacttctttattataacattaaatttgtttcattatttcttaattttttttcttctggtaattagatactccatcaattaagagtgcagcaagtttcatcaaaaagaaatcttataggagtgcaggcttgaattttacagaatcaaaaatggaatcaaacaaacagtcagacagtttcatcaactatacacttttttggggaaaaaaaacgtacaacttaatgctccctgacataagacagtaaattaaatctctacagagatttatgagttggacatgtcaataacatccattttcttttgccagataacttaagtacagtaagagaaggggaataatatgtaaatcatgagcagacaacgttgagaactgcttgaaagagctgtaaaaattaattcaaagggcatttacatgtataagttttcggtacctaacaagacttgtcaaccatactactcattttcactaaacttgtctggtgtaccctcttcacagcttaccattttattccagaaaacaaaatttccatatttttgccaagattcatgttttctccatgatatgttactatagtatctgaatgccaatctttgtttcatcattcttcattactcgcatctgaatgtcaatcttcgtttcatcaatatttcttatccttcaacctatatgcttccacaaatttaaactttgcaaaagttgcaatccatgagtgatatattggtctcttaattagtcatattgttttaaaaattggccataggctgctatagggattttgaacttaaaccactatgctatgtgctatagtgccttgtagcatttaggcctataacacttaatatagagggtaacaaactgccacagtggccaccatgcttttgggttatggtgggtgctatatgcaagagcaagtttaaatgaacataccttaatccttagcatgataagaaagttcaccaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttgtttggatacttctacaagacttggctgaagatcctacaagaatcaagcctgctcgcctatctagctcatatctttcaagggcctgctaaaatgccagcccaaatcacagcctttgggcttcaagaagaaaaaaagatccatggaggtcattttttgttcccacaagatttggaccgagaggtgtttggttgatagagccatgcttaaatgaacggcccattccatgaatcccgcaagattttcagcccaatcttgtaggaatatccaaacaggacctaaaaaggattcggcaagactaagatggacttgatttgctaatttttggaacttccaaagtatgatgagtaagagaaagagttggtggttgggagacttcaagcaagatccaaaggataattctaagctccccattttggaagaatgtgacatttgctttgacatggtgggagcccttataagaagtgctgaggtatggccatcggttataaatggggttatttgatgaatgctaagaaggagatagctttccatttgaacaaagatggaaaaaaaaatcttccaatttggggattcactgattcaagatgggatgtaaaatgtaaaggcccattgcatagggcgggttacttcccgaacccttcttctatgctaataagaataaaattgaaaagttgagtgcattttaaagttcgaccctaatgatcagaatttgcaagatgaaatttcaagggagattcttttatacacgagctgcaggatcatttggaagggagatggccattagccaaaggtcttggcccaaacttactaatgtgttaattgttagtaacatgtctctgtgtcatgtgatatgaatattcttctgagaataattcatcttttaatcgatgaatcaaatatatgaagctaaaaacttattatgtgtataacttatgaaattaggtcagtgaggttttatagctttgtacttgatttgatgaaaaagtattgatttgatacttagaaaatatattgatatattttaacaacctactttgggtttgtaccacctgctatagtgcctgctatccactatttgctatgaaattccctagccacaacatgcccattagccgttatcacacttgacattcttgagtcatatcaagtaagaacaataggttttgagcaaggatttaggttccacagaaatgatatggtaccatcagcaccatcctgttctgataggatttgggaccacaaatctatgggacatcactcgattaataggtcaggatgccctccctgttctagccaatcttgttggaaccaacaagtgccaagtgcgatttggccggtaccaggcacgttccaatcaaattgcttgatttcaaaattaaaaagagagaaagcaatgaggggccattctctctctctttggcttagtgcagggggcaatgcaggtaaagacagagaaagaagggagagagagagagagggagaaaaagaaaaaggagaggacaaaggaggggaaggagtgcagatcctgcattcagctatcagcctgttccatcaagaaacctcatcaataacatgtcaatattcagttaaatattcatttaagacaaaagtaaacttgaacaagaaaaaaaaagtgtccttatacactaattggatgccagacaatcccaagtgttgggatgagagtattccatacaatcccgaacaaggaaaacacctaggtatttttaaatactcatttttgcacccttgcctacacccaattgctacagtatcattatggtacagtttaagtattgatacagtatgagaggcatatcatgaattgattccctactgatatattatgagacattcgatacagaccaatataatgcagcactcaaaatcatgaataccatagcatctgttaataatatgaaccatagaggtctcctaattgatttcaatgagttgagtttacaggaacagaaaaagagcagctcaaaataagcctgcaatgtacacttgtcatcattggaaactcaccaattttcccatcaatttatactagtggactgaagtcttgtacaaccctatgacccaacaaatatgtaaacaagacaagcttttcttatctcttctgtcataaaatcttccaaatttctatcattctacttccatgaacatggaagaatgatataagattattgatttgctgaattaacatgccatttgcttgtgctcgaatctaacttatagaaacaactaaaggatcatagattctcttatctgtcagctcttgctatttatcattcatcttaatgaactaaggattgtccttgtgctttcctctatgcttctctggttttctcttgatgttgactgctcttgtcacaagggtatggacagtctattgccttgacttcagactaattaaagaaccagtcaccgctagacattaaatcccctgcttgctaaaagccaattcataattgatgggcttgaatagggagttcatcatctacttgagaaaaataggacataggatctgctttcatgaataggaagctaacaataaaggcatgataataaggctcagttaatatcttttttcttttagatgatggagcagagtgattagcagctttcctaactactaataacaggaaataattgtaggagcttttctcatggtctatctatctttagtttatcatttgcaaatattcttttatcaactctcataagtagttatttctggaggattaatatattgatctagttcacaaagatgaaccttcatatcgaataaagaatttttggcttttgatatttcaaatagccagtcaattctccaccctttcaaccatgttaaagaaatgcatgagcaacaaaaatgccatgtggatgagaaactatatatgattttgtttaggatttgttgacataccataacatattcccaaaaaaattgaaaaagctttctaaaattccacaactgtctccgcatggttccataagactaaagctgcagctacatagccacacatctcctagttatgggtaagtggcaattcaaaagatttggacagcttatggttcgaacattttcatacatcgtatgggcaaaactgaagagaaagataataagtccaaaaaatttaggatcggagtacatctgcttcagcttttatctttttccaggggtacgcaaagtagacagttcagaaatgaaaggtatggtcataagcatataaaggcaccactccaaccagggaacaatatgctaccatgatgagatgttcagttcttttcaccatttattctataaactttccttttccctcctatctttccttatgagtactgaatggaggtattttagcaaggaataaagcagtttgataaagtaaaccagaagaaaatttcaaatggaaataaaaaaatccgtagtttatggaaccttttgtcatggggacagtagattgcagcttcaaacaataatgaggcccctaaaacactatccactttattatgtgagggttgcaaaagagagtagttgtaatggctggaaaatgggcaatggcagctgtatgaacatatgtaactctccttgcaccaaagagagcccaaaagaagtttgaaggatcatcaaaagctaacatagcactagcagtcctgctttagtggctactctttaaagctactttctatgttcttgtgtctcaatgattatgaagaatgtctaacatatgatagttaaactctgtagataacccatattggctgccattactggttttccatgttgctctctaatatttgaaaagcagcgagatgagaaaagtacaatgatgaaacttatctaccatatttatattcaatatacctgtccttgtcataatctgctggaagcttcacatgatctctatcaggcgtcacttcagaaataaagatcaaagccatgtttaggttgttcctcattgcttacagaaagttccctttgttcatatcattttgtgattttttttgaagttcttctattttgcttggattggcacacttttatcatcagattggcgtgaagccaatttggattaatgaaattcttcttatttgcctggataccattggacttccatctaaatttctatgatatacttaaagacttcataagttcggcttaggtgataataggttcgctgaaccggtcccgaggctggtatcggttggcgactagcatggtacaggtctgtattgtcccattctaggatgaacttttttttttttgctgaattcaaactgaagttggcaaatagtccctttttttttggcccatttggaaagtgaagtcggcaaaccatgagagcttaaagcccatttgccgacttcagtttcaaattggcaaaaaaattacaaggcatctcctatttccaaacgaaacaggagaaccccctattgacaagccatgagagctttaaagccctcgtcccgcacccccccgtccctctccctccctctcttttcctctctctccttctccctctccctccattttgaatcagtgcattgaaccgtgccagtaaccaaccagtccaggtcagggttccgaatcaatgcactgaaccatgctgttaaccgatcaatccagtttggcactccccaaactggccagtttggcatagtgcaacaatccatgagtgatatgatacttatcttagtggcttattctttttaaaaatatagctacattcaaatagtgtttgaaatttcacccacggaaggcacacagatgcatgaatatactccaatgtatcatgttacaacaaattattctagtattcaaattgaatccaagtagttttaatgtatgataccttgttcccgataaggggagaattacttgaataccatgtgtcctgcctctcactttggcaatgagcaaaacatgaatttataaataacccattttgcccgtacgtggagaatccttttacagcattaagcatttgattccggaaccctgcattatagaaagcagccatgtaaatggtttacctgttttacaaagccaaagctggggaagagaagaaaatgaataccttgcagaacctggatttgatatgcatcacattttgcataattcattttacattctcgccagtaaccacgaggatcagctgttctgggagctaaactttcctgaatctgcaaattcagaagcagagaagaaattgttagagaaaatagaggtgatctagttaaccttaagtttgcaccactcattaatcaagggttattttgaagtcattattctgaaatatgaaaacttaataagaaaaatttacatttgcagtcataggctcataactccataggttcagtcacaggttccttaagtaccatttcagtatcaaatgagaacatttacatgcttttaaggataagaaaatacctgccatacatcataggctgtattcaaaagaaaaagtggggtccgaacattggccacaatgttctgtggaaagaagcactgcaaagagaaaatatggggaagaaaaaaaaaattcaaaacaaagcatttcaatttagttgttgctactagtcatccatctatatgaagaaagtaaattaccgaagttgcatccatgcgagaagtacaagtccttggcaagttctttgccgccccctgggtagtcatgagagtttttcataaacggaatagcaatatatcagaaatgagctaatagttaattccttacaactcaaacatatatcacatagatacctgaaagttcacaacacctccaaagaaggatctcagggttcgcccacctgctacatcaactctacaaattgaacacaaaatgttatcagcagaaattagagaaaaacacagattagaggtgtatttagcaaataaaaaacatacattattaaaaagtttatgttcaaatacagcaatgaatagtggatgcacataacttagacaagagatgcgagagtaaaattaattttgtcaagaacatacgcatcaagaaacattccggcatcaccaaggcacttgacttttgttcttcttggaaataatgctcgaaattcatcacagtgtagaatggatgctagtcccccagcagaacaaccagaaagaagggcctgaaagcattaatataatatattcactgtagaacttgaaccaagatcaagaattcaagatcacatcacatgaatagggtaagaagacctggttggcataacgcattccctttgacattagatcttccatcactgctaaccagatacgctgccctcgaaaatataggccagcagcctaaaagcgatagagcaatattttcatatctctgagcatatactaacaaatatttatcgggcaaagacttcaaagaaggtgaactattaaaatctcagaagtcaaaatgcatttgatagaaaacagtaataacagaaattgaataaggccggacatagcttattgaaagcattattccttgcagatgatatgatgcagcttaattcatcttcctgtaaacactataaacattcggaggaaaatttcagaaattgaaaagcatataaacagtcataattccagtactgcacgatgttatcaatccgtaatatttttccccaaaaccagcttcatgagctgcagaggaaattttaaaacctttccataatgtatcaagttgtaaattgcaataaggacattttcagatctctgaaattgcaccaaggttgatcttgagaagtatagatcacctctattgggaaaaaaatggattcaagtatgggccacaattaataactttcatggatcatctcttgaaactatactatgctttaacctttaacaaaagaatataacatagaaatctcaagttatgaattctggtagaaaaagaatatagataagaaatattctttttatgtaaggaccatcacaaaagccctatatttctctgatgtgatgatgctgaaataatgatgatcccttatataataggccattggcaactcttagaaaatgcaaattgggtatccattatgagataggcagccagttagaaagctgagaatagaagtaggaacaggagttggagctatagcaagaattagatatattagagggaacaatcaactctattccttgtaatgtcaagtggcaatggacatggtggtgcaacagagggtgcagtcagggggtaggatgaccaactggaccatcccaagtttcacatgagctagaggattttcaagcaaatattttgacaagcaaatatttgattttatttcagtgggattttcctataaatttttttattggagacaatatcctattgcttgctaggtttctacttttgtagttaaataattttagcatgtttccttcttattaagtcctatttctagcacaagtttgtagcagttttaatgcccaaattaggcatcatatcctatatgtgcttctattacacaatacattgtatgaaggagggctttttatattttaataaaatttctcagagatcaaatgcccttaattgataggttgatcttccaagcttaagcatggggatcaaatcactcttcactcttcatgctgcatcaaatggcatgaagttgcaatctagtttgagattggtgccataccatagctatcccttcataatactgctaaacatctgataaaaattgttgtaggatgatgccatgaggtggaactgtgtattctaagaaaagttggaacagattcatgggtccagaagaaataaagaccttggcaccaaacaagtaaaagagagagcttcttgtaatggagacttgttattctttccatacataactgcagtcccctaattctgaccgcacaatcaattccatgaattatatgaagaaagttgcattcatgttcattattttggtgtgactgttgattttctgaaaagtacctttggagttctagttccatgtagtgtaccttctacactcatcagaaacatgatgacatttgcaaataacatgccacatcaaaaattcatgcatcaataacaaggacttgaagtttcagggaaaactctaatcccttaataagaagtttgaacaactgttactcttccctcatacccattctgtacctctcaaggttcgtatgcattattttaatgcttccaagtaaccctttggatttttgtttcttcttaccatccatcaagtaggatctatggtactctgagtgcacgtatctagtataatttgaaggcttttctctttgttctagagacgtcctcatgacaaacttgaataagataaccacctcctctgttggtctttttggcaggagcaaccttacctgttcttgttcctgtcagttgcacccaacagttgcttcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttttttttggtatactaagaatgtgacctgttacggtggtaccgtgaaaatcttagagttatgttatcaagatatacttcgggccgccgagctatcgctgtgactcccgacctaagcacagagctaaggtatacggagccgagctatctacatcctatccactatatgatctgttcagcacaagagctgccttcgttatctcgaccaacgaatctcctgacacatacagcagctgtccaccttaagtagataagctcataggtaaccacctctcctaatttcatgggagcgattaaaggctaaaatatctcacccgtaatagcatgttcaacggccctgcaatcttgggattgtacgatttcacagttgttcaaacaactgttcgataatattctacataaacaatcaaagctccgaggatcaaaataagcaatccctctcagagaatccattgttgctcctttgttctctgatttctgacttgagcatcggaggattctcgtcggagcgaaaatctttggctcggatttattttgcaagtcgttccagcatccctatgcaagactcagtcacctgttttccaacctccataagaacgagcagcaacagatagagaaaggatcaatcttcattatgccaccaaaacgagtatcattctgactctctaatgccgccacctttcatcgggcggagagctaggccaacagccaggtgcagcaaccggcgatggagactctatcaatccagccaacactggttatggcagaccacttcaatctgctctttcagcaagtccaaaatttgatagctgccgttcaagcagtccagactgttcttgtacatcctacaacagcgccacagcttgctcagactgcccctgcacctcttttagcagtgcagctagtgattttctcaatgccaccagcgcctcccgcagtgatgcccccatcaaatccgactccacattcggctcctcagctgctaccacaatcagagctacatgtgcttcctcagagttcggaaaggaggcagacccaccaaagctgtcacaaggcctaacaaccggccaggcggtaatctcttagcttgcgatcagggcatggttcaatccctgatcaccattctcctcagcattcgaaggcttgcaccatttgcgatcttgctatagagaggaaattccaggcaattgataggtggattgatgccgccctcaacaatactttctcggtgtagccctacaatggattcaacaatgagccatcttttattctgaggatagtgcaggagccgctccctcaatacttcaaggtgccataatttgatacctacgatgggattgtcgatcccatcgatcaccaagagacattcaaggtggcgatgctccttcaaggggctacatatgtcatcatctattgagcatttcctactatccttaaaggggcagctcgacagtagtaattcgagcctgaagccggcttccatctactctttagaagagctaagctggtctttcatcgatcattttatcagtagccgacaacagtaaaagtgatccgactacctccacaccattaagcagaaggagggaaagttaatccacacctttatcagccgtttcaatatggcaactttagaggttcatgatctgaatcagtcgattgcgatggccgtcatgatgagtggtctactgaagaatgacttaaaaaaatcattgaccaagatttatcctcgaaatttttccgacatgcttgtccgtgcagaaaaatatgcttgtacgaaggaagtttttgcggaggagatccctgccagttttgttgcagtatgatgaaataaggagcgctctccaagatgggaggggagaatctgtcaacactcccagtccccaacctagaagtgaaaaaatgggggccataattatcgatctcggagtcctcggagaaagaatcgacaaccctcacctccaaggtgttatactaactacacgtctttgactgtttccaggagaaggtactgatggaggtacgagccgagctgcctcaacctccaaagttgcggacgaggtcagagcactaccgtgattcgaataaatactgcttctaccattgtgaccacggtcacgacactgaagattgtattcagcttcgggatgaaatcgagaggctcgtcaggcaggagagattgaatcattttatctggaggggtgtatcttaatatcgacctctaagggctgaacaatcacatcctttgcctcattaactgttctctctgcctcagcctcaatcgcagccagtaccaatgcagcaggagaggcaagaagtagggggaccggtggcagcagaagaccgacccatacagagagaaatccatatgataatcggggggtcgtctgggtcagcgaagctttcgaaagtgaagaaggcaaagctcgaggataggcatgaggatgccatcatcttcaccgagcaggatgcagagggtgtgctagccccacacaatgatgcagtggttgtaatcgtgaatattgttgattataatatgcaccatatattcattgataatggaagctcggttgatgttttatattattctgtctcttccaaatgggattcacttcggaccagctaagtaggttcgatacccctatttaggatttctccagatgttcaataatttcagaggaaatgattaagctgcctgttatcgtgggcacaccaccacagcgaacgacgatccaagtcaacttcctgatggttaaacttccttcaggctataatacaatccttagccgtccaagtttgtgaactttaaaggctgtagtatcgagctatcacttgatggtgaagtttcaaactaagaatggagtaaggcatatccgaggcaaccaggccatggctcgctagtgttttgctgctaagcttcaagcaaaaggctagccatcccaagcaaaaggctagccaaacctgaactttcgataggactggaagcccgagatgatctgtccgaggagcgtgcctagccatctgaggacctcctcgagattccatcgaggaaagagaaccccaaccagacagtgaagatcggctcacacctggacgaggtaaccaaggctcgactaaccgctcttttacagaaaaatatggacctctttgcctgatcgactgcagatacacttgatatagacctagaggtgatgttctatcatctgaaagtggatctgacttgtcgtctggtgaagcaaaagaaacgaagctttacccaagagcacaaaaaggccgtatctgaggaagtagacaagctactcaagattggcttcatcagaaaagtaatgtacccagactgatgagcgaatatagtcttgatcaagaagacaaatgagaagtgacgtatgtgcatcgacttcatcgacctgaacaaagcatgtcccaaagacaattatccgttatcacagatcgaccagctggtggatacactttttgggcataagcttcttagcttcatagatgccttcaccagttataattagatccggatggtgcccgaagacaaggagaaaacagtctctatcactgaccgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgtcaaaaattattatatttacgatgaaaaatttatgtcgctaatactttttaaatttaatttttataaaaatttttaattaaattaatagcgatgcataagattcatcataaataattattttttattagtgacaaaatattttatcacaaattatattttttatgatgaaaatttttcatcgtaaatagttttcaaaaaattaattttttttcatgataaaatttttttgtaggaaatatccattatttgtgatgaaattttttttctatcgtaaaattatcaacaatgcgattatttatgtctaaatattagtgataaaaattttatcgctaataactattagcgacaaaaatcgattattagcgatgaattttttttatcactaatatcctattttattgtagtggtgatgccctttggcctaaacaacactgggactatctatcagcggttagtgaataaaatcttcaaagactaacttgatcgtaatatagaggtatgtatggatgacatgttggtcgagagtcgagccacttcaaatcatattgctgatctctaggagaccttcaataccctccgctgatttcgaatgaagttgaactcagcaaaatatgctttcgaagttattatcggtaaattttttggatttatgatctcacgaagaggtatcgaagcaaatttcaagaagattaaagcaattcttgagatgacgccaccatgaactattgaagaggtacagcatctcatcagtaaggtcggtttgctcaaccgctttttcaagttggctgaaaggtatcttcttttcttccaaactctcaagcagtcaatagactttcaatggattatcgagtgccagaaggcatttgaggagttgaagcaatatcttagctctccaccactgctcgcgaaacctcagttgggtgaagagctattgctgtacctcaccatctctctagtggcgattagcgtaatcctcgttcaaaaagaagaacggatgcagaagcccatatattacactagtaaagtcctttatgatgcagagaccagatactccaagctggagaagctgatctttgcactggtcgtcacgatgaagaaacttcagccttattttcaagctcacactattgtgctgcttattgatcaaccaatcaaggccgttttctattgtatagataccttgggatggattgcaaaatgggctctagagcttttagagttggatgtgcaatactatccgaggccttccattaaagcccaggtgcagcagacttcatcttggagtgcaccatcctgaatagacaaagctcagaagctggagaaggtccaaaaggtggagagagctccaaagctaagaaaagctcgaggagtgaggaagtggatgcagaatctgatcttgaggagttatggacgctgcatgtcaatagcttatcaaatgcatctagagcaggggtcgagattatcttaaccggttctaaaggagatatagcaggatatgctctgcgctttgactttttggctactaacaatgaggtagagtatgaagttctgattgctggcttcaaagttgtaagagaagtaggggcttaacacctgaaggtcttcagcaactcccaactagttgttgggcatatcaagggtagatacgaggtccgagagaagaatatgaaaaaatactttcagaaggtaaatgatttgatcttaatctttttgaattttgatattcagtaggtctccagaatagaaaatgctaaggcagatgcactattgaagcttgcggctttactacctgctaacctaaaaaaggggacctattttaaggtattaaagaccactagcctcgaagagcctcttgtggcccagcaaattgatgaagaatcctgttcgatcgattctctactcaaatatttgaggtcagtcgagctaccatctgatcacaggaaagtttgaaagataagaaagcggtccgctcattatattttgtatgatgacaagatgtacaaacagtcattctctctatcttttttgaagtgtttacacccgtctgaagttgattatacactgcggaaggtccacgaaggaatctacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttaaatctcaacggcctttgatcagccttaattcaaaatcggcctagctactgttagagtttctttgctcgaagcattcctactttccatgattagaactaagttcatggcaaagcttaatatcttaagtcagttcgtgtgctgaataaaagtgcacaatcacaaataaaagacagaggatatgaagaaaaaataaagttcatttcttcaaaaatttttacaatgacctcaaaaggttcaggtacaaaaaaaaaaagataaaggcctataaggtagcatcgggagctgagacgtccgtcgcggatacatcggctgcagcagattttcaaagtttatccaaaaaattcagatttaattctggatacttgacagcaaccgtatcccagaccagttgcttcccaccggcataggcatcagcaaagaactcaatcttctcatccttatactctattgatgcccgaaagtccgtaacagcccttgaggcggcctctgctgccttcttctctactgtcttgctgcagctttactcttctccaattgggcttcaagctcccttcttctcccttacagtcgagagttctcttagctcctctcagggccattttgacatcttcagctctcctttcaatggtgtcggccctcattgaggctttctagcctcccttacagctttgtctttggtgcccttaagtgtctcgacgttggcttggtgcttccttgcctcgactaaaagattgcggcagctctccatatgcccattcagataatggacgagctatcaagagaaatctcttattagtgcacataataagtggatgtttaaagtaaacaaaactacaaaagcttcaacttatccgaatgaagctctctacagcttttctcctcaccttcctgcatggttcggccagtagcttggttgcatcaactgagaggagcatcctgatgaatggctcatgcgccagctagtagccctctaagatcgaagtctcgagcttcagtgtagctggcatggccccagaagtctcagcctcattggctggctcatcttctagagaaaatgtgatgataggaggagccagcaagctcgaaattgtctcctcgagaaccaacaggctaaaaactgcctcctcagtggctcgactggtttggcttctttgatttccatcagaagctggtgaagtcgagccagattgaatcctcatgactctgaagttgccggcacgaggaggctcaggaccttctggcccaggaattgacagtgtcgggggatgtcttatcttgatacgagtactccatccatgcataggttcagctatcctctttctttgggctttcttctccacctctttcaataaattcaagtccatctctgcaactatctctacaaccaaggcaaccaaatggttagcataagggtaaagtaaaaattaaaaaacacatggctctgagacaggtgacctatgcataccttgaggaccagcttggctgaagccggtgttgaacagtgtctgaaccgacataacctgcttcagcatcgggaccttgaagttatgcagagcctccatctcctgcctctggcattgatccaacaaaggttcttttagcacagcctcttgaggttcaccccaggcaacgaaaccccagtcctcatcagacgtctgagagacaaagaagaatcacttcttctagtcgtggacagcggtaggagcatcctatatcaatggacggacatctttcttttttcatgtcatcatgtaccatcacccatgtgaatcagaatacctcttgaggttgaagaaagaaaagaagagtgtgatattgagatcaaccccagctaacatgcacgctacggtaaaactgcaaatacgtcgccatgagttcgggacacgaatatggcgacatctcaagatattggaggagagctacaaagaagggatggagaggaagcctcagtccagtccagaagcattccttattgaggcttatccagcttcggagagatcggcagactcgatcatttggtctcagaatttttagttggaactctaaagggatttaaaactactcatgaagtaataccacgtcccgctctattagctcgaactgaaattctagtgggacgaaatcagagtctctaaagaccattctccttgcaggaagagttttggaagcaaagaagggctctagaagcaaagaacgaaggagaaaaaaaacctacagtgaaaggaaatagggacgactaggaaccctaaaagtctgggcttggtcttgtctgagatcttaaatagacccagggttcaaatcatctccaaacaatgcttctttttaaaacattaattattggtggtatgaatcgacagagtgtgaacggacgcttgacgcatggcaaccactgatggaatattacctctgccatggatatggtagttaatgccagcgataggcaaatcatactttgtgtcacttttcaagagacatgcgaagacttgcgatggtacctgccatatggaggtgatttgaactccaattcttctaatgcctacataacagatatgaattatatagctcggattacagtccagattgtggctcaagtcgtgctttgctcagaatgttgctcagatcatgtatttgctaaattatagctcaaatcgtattttgtgatttcaattatggctaagttcttagctaatacagatcagaactcaaccaatatagctcagaatgtgatttgcactaattcattcaaatacagtgaatgttatcaacaaaaatgaatttcattcatttacatctaaaattggctacatcatctgggttacaaaaagaaaaaaatacatcaccaccccagagcatcgtcagagcgacttgctccagagcagtcttctttagtgctggtagcttcctcaatttggactgtcgcatcgaccttatttgcttcagtagagtaatgagacgctcttgtaaatttctctacgctatccaccgtcacgactttcaagctttcatctaaaaagttgatttgtagaagctcgatactgtcagtaggaaaatgtgcttgagccataattttacaattttcgaagcccgcatagaacgccatcttgtaagcctgatttatgatttcggctcctttttttgccaatcgacctttccttcttttagcactcgtagccagaatctcctgatctatgagtcagcgccaaaggagatcctgattctctctgttctcctttagcttcttcttcaagtgctttgcttctggtgaagtctctcgaagttcagtagacggcaccaaagatatgtggatccctttggaagcagagcccttacccctctggggtgttttcttcctacagcttgctctttttgaggttctgaccctcttagctgagcttctgctaggactccttgaaggatgaacctcagaagaagtataatctcgacctcttttccctcctagtgtcttcctcaggcatctctatatcatcacgggtttgacggcaatctctttcagtctcagacctctgcctctcgagatcattgatcttcttttcagtcttagatctctgtcgtttgaaatcttcaattctcttctcagctctcttcagctcgtcgtcccgatagtcaatcatctctcgagcttctcgaagggcctcttcagaggagttggcttctttaaccaactcgacgttagccgatctctcttgctccaagagatacttcagtaagtctattttttccctcgctgctgtaagctccagtgttaatgcatcagaggtggggccaatgaaattggctagataatgcccaacttatatacatttatatgaagtcgttggatgatacaagttatagaagacttaaaaaaaaattcgaaaaccccttacttgggcgagagatctcagggcacccttcatccactgttgagccccttgttcatttaggtactgcctcttaacaggagagaagaagcccctcagaaactctaccgcggatggagcagaagtcatcaattgcgaaggtcctgttcgaatgactactaggggagggcactggattagaagcgtctaccccaaagactttccagcctccatcgttatcgccagaacttcctcaagatggccagttgtgtccaccactggtatcttctccatcggtctcttctatgtcggaacctcctctagtggagtttttcccacaactttcaatagagaaaccatgggctcagcgatcaaaagaggatcttcatcgctcacgaccacgatagttattctagcagccagaaccctaacatcgccacccgttgggactggagggccaatggatgaaactttggcttgcttcttcctggccaataccagttcaagctttctcaagtactctggattcatcttgtctccgagagttacaacaaaaatctgaagcaaaaaagccttacagtcatcttctctatacacccgaagggcaaatttaaaagaagacaaaggtgaagataaaaagctgctgctagaaaaattaaattcttgagaaaattgtcagctatatggtcccatcagtcgtgatcattcccagcatactttcgtctatcaagctgacatcatcaactttaaatgctgagggcacgtatgaaagcgcaagagtgcgcatcctttgatccaagatatgatttttgagatacttctttcatctgattcttagactcaggaatagagaggtagtgttatagtggtaccgtagatacctcagatctgtatgttatcaacatttatttcagaccgtcgagctatcgctatggttaccgacctagcacagagctgagatatgcaaagccgaatgatctacattatgtccactgcgtagtctgttcagtatgtgagttgcctccattacctcaacaaataagtctcctaacacatgcaacagctgtccattctaagtggataagctcggaggtaaccacctctcctaattttacgagagtgattaagagctaaaatatctcgtccgcaatatcatgtttaatgatcctataattttgagattgcacgatttcacagctgttcgatcagctactcgataacattctatataaataaccaaattttcgaggactaaggtaagtaacccttctcagagaacccattattgttcttttattctttaatttctgatttgagcatcggaggatcctcactggagcaaaaatctccgactcaaatttgttttgttggtcgctccaacattcctgcacaagatttagttacccaccttccgacctccacaagaacaaacagcaacatgacgtaaatataatatttgaatgtcactcaatttgatcaagaaagagtattttaagataataaaaattgttaaagagataaaaataaatattatcctaccacattacctaaaaaattattacataatttaaaatattactacaactttagccctaaagggtcggggaattgggtcatggacctatataaatataatcatattattttgataacctttggcagttgttagattttcatgattatcttgatgcacggtccttagaaatgctctcttgtagtcaacttgactaaagtatttgcttaaatcatcataaattcgaagccatattttttaaataattttggatgttcaaagaagcaatagattatgattattatttaaaaaattgatgtcatatattttcttaattagtgctatatgcttctttattttttcaatattttttaattttttaagcaaaaaggtatgtttgttttatcaaaaaaactttaaaaatttgtggccgctgggattcgagcccaggtctccacgaccacaacgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttaaatctcaatggcctttgatcggctttaattcaaaatcggcctaactactgttagagtttctttgctcagagcattcctacttcctatgatcaaaactaagtttatggcaaagcttaatatcttaagtcagttcgtgtgctgaataaaggtgcacaatcacaaataaaagacagaggatatgaagaaaaaacaaacatcatttcttcaaaaatttttataatgacctcaaaaggttcaagtacaaaagaaaaaaagataaaggcctataaggtagcatcgggagctgagacgtctgtcgcggatacatcggctgcagcagattttcagagtttatccaaaaaatttagatttaattctggatacttggcagcaactgtatcccagaccagttgcttcccaccggcataggcatcagcaaagaactcgatcttctcatccttatactctattgacgcccgaaagtccgtaacagcccttgaggcggcctctgctgtcttgctgcagctttactcttctccaattgggcttcaagctcccttcttctcccttacagtcgagagttctcttagctcctctcagggccattttgacatcttcagccctcctttcagtggtgtcggccctcattgaggcctttctagcctcccttacagctttgtctttagtgcccttgagtgtctcgacgttggcttggtgcttccttgcctcaaccaaaatattgtggcagttctccatatgcccattcagataatggacgagctatcaagagaaatctcttattagtgcacataataagtggatgtttaaagtaaacaaaactacaaaagcttcaacttatccagatgaagctctctacaacttttctcctcaccttcctgcatggttcgtccagtagcttggttgcatcgattgagaggagcatcctgatgaatggctcatgcgctagctagtaaccctctaagatcaaagtctcgagcttcagtgtagctggcatggccccagaagtctcagcctcattggctggctcatcttctagagaaaatgtgatgataggaggagccagcaagctcgaaattgtctcctcgagaaccaacaggctaaaaactgcctcctcagtggctcaattggtttggcttctttgatttccatcagaagctggtgaagtccagccagattgaatcctcacgactctgaagtcaccggcacgaggaggctcaggaccctctggcccaggaactgacagtgtcgggggatgcctgatcttgatacgagtactccgtccatgcatagattcagctgtcctctttctttgggccttcttctccacctctttcgataaattcaagtctatctctgcaactatctctacaacaaaggcaaccaaatggttagcataagggtaaagtaaaaaattgaaaaaacacatggccctgagacaggtgacctatgcataccttgaggaccagcttggctgaagtcggtgttgaacagtgtctgaaccgacagaacctgcttcagcatcaggaccttgaagttatgcagagcctccatctcctgcctctggcattgatccaacaaaggttcttttagcatggcctcttgagattcaccccaggcgacgaaaccccagtcctcatctgacgtctgagagataaagaagaatcactccttccagtcgtggacagtggtaggagcatcctgtatcaatggacggacatttttcttccttcatgtcatcatgtaccatcacccacatgaatcataatacctcttgaggttgaagaaagaaaaaaagagtgtgatattgggatcgactccagctaacatgcacgctacggtaaaactgcaaatacgtcgccatgagttcaggacacgaacatggcgacatctcaagatattggaggagagctacaaagaagggatggagaggaagcctcaacccagtccagaagcattgcttattgaggcttatccggcttgggggagatcggcaaactcgatcatttggtctcataatttttagttggaactccgaagaaatttaaaactgctcatgaagtaataccacgtcccgctctattagctcgaactgaaattctagtggggcaaaattagagtctctaaaggccattctccttgcaggaagagttttggaagcaaagaagggctctagaagcaaagaacgaaggaggaaaaaatcctacagtgaaagaaaatagggatgactaggaactctaaaagtctgggcttggtcttgtctgagatcttaaatagacccagggttcaaatcatctccaaacgatgcttcttttcaaaacattaattattggtggtatgaatcgatagagcgtgaacggatgcttgatgcatggcaaccactgatggaatattcccctgccatcgatatggtagttaatcccagtgataggcaaatcatactttgtgtcacttttcaagagacgtgcgaagacgtgcgatggtacctgccatatggaggtgatttgaactccaattcttctgacgcctccacaacagatatgaattatatagctcggattacagcctagattgtggctcgagccgtgctttgctcagaatgttgctcagatcatgtatttgctaaattatagcttaaatcgtattttgtgatttcaattatggctaagttcttagctaatacagatcacaactcaaccaatatagctcagaatgtgatttgcactaattcattcaaatacagtgaatattatcaacaaaaataaatttcattcatttgcatctaaaattggctacatcgtctggattacaaaaaaagaaagaaaaatacatcaccaccccagagcatcatcagagcaacttgctctagagtagtcttcttcagtgctggtagcttcctcaatttggactgtcgcatcgaccttatttgcttcagtagagtaatgagacgctcttgtaaatttctctacgctatccaccgtcacgactttcaagctttcatctaaaaagttgacttgtagaagctcgatattgtcagtagaaaaatatgcctgagccattattttacaatttttgaagcctgcatagaacaccatcttgtaagcctgatttatgatttcggctcctttttttgccaatcgaccttcccttcttttagcattcgtagccagaagctcctgatctatgagtcagcgccaaaggagatcctgactctctctgttctcctttagcttcttcaagtgctttgtttctggtgaagccttccgaagttcagcagacggcaccagagatatgtggatccctttggaagtagagcccttacccctctggggtgttttcttcctacagcttgctctttttgaggtcctgaccctcttagctgagcttctgctaggactctttgaaggatgaacctcagaagaagtataatctcgacctctttttcctcctagtatcttcctcaggcatctctacatcatcatgggttcgacggcaatctctttcagtctcggacctctgcctctcgaggtcattgatcttcttttcagtcttagatctctatcgttcgaaatcttcaattctcttctcagctctcttcagctcgtcgtcccgatggtcaatcatctctcgagcttctcgaagggcctctttagaggagttgatttctttaaccaactcgacgttagccgatctctcttgctccaagagatacttcagtaagtctatttcctccctcgttgctgtaagctccagtgttgatgcatcagaggtggggccaatgaaattggctagataatgcccaacttatatacatttatatgaagtcgttggatgatacaagttatagaagacttaaaaaagaaattcgaaaaccccctacctgggcaagagatctcaaggcacccttcatccactgttgagccccttgttcatttaggtactgcctcttaacaggagagaagaagcccctcagaaactctaccgcggatggagcagaagtcgtcgattgcgaaggtcccattcgagtgactactaggggagggcactggattggaagcatctaccccaaagactccccagcctccatcgttatcgccagaacttcctcaagatggccggttgtgtccgccactggtatcttctccatcggtctcttctatatcggaacctcctctagtggagtttttcccacaacttccaatggagaaatcatgggctcagcgatcaaaagaggatcttcatcgctcacgaccatgacagttattctagcagccagaaccctaacattgccacccgttgggactggagggccaatggatggaactttggcttgcttcttcctggccaatactagttcaagctttctcaagcgctctggattcatcttgtctctgagagttgcaacaaaaatcagaagcaaaaaagctttacaattgtcttctctgtacacccgaagggcaaacttaaaagaggacaaaggtgaagataaaaagctgctgctagaaaaattaaattcttgaaaaaattgtcaactatatggtcccatcagtcgtgatcattcccagcatactttcgcctatcaaactaacatcatcaactttaaatgctgagggcactatgaaagcgcaagagcgcgcatccctagatccaaggtatgattttttagatacttctttcatctgattcttaaactcaggagtagggaggtagtgttatggtagtaccgtggatacctcagatctgtgtgttatcaacgtttatttcagaccgtcgagctatcgctatggttaccgacctagcacagaactgagatatgcgaagccgagctatctacattatatccactgcgtagtctgttcaatatgtgagctgccaccgttacctcgacaaataagtctcctaacacatacagcagttgtccatcctaagtggataagctcggaggtaaccacctctcctaattttacgagagcgattaagagctaaaatatctcgtccgcaataacatatttaatagtcctacaattttgagattgcacgatttcacaactgttcgatcagctactcgataacattctatataaataaccaaagtttcgaagaccaaagtgagtaatccttctcagagaacccattattgttcttttattctttaatttctgatttgagcatcggaggatcctcactggagtaaaaatctccggctcgaacttgttttgttggtcgctccaatattcctgcacaagatttagttacccaccttctgacctccacaagaacaaacagcaacatgacgtaaatataatatttgaatgtcactcaatttcatcaagaaagagtattttaagataataaaaattgttaaagagataaaaacaaatattgtcctaccacattacctaaaaaattattatataatttaagatattgctacaactttagccctagggtcggggaattgggtcatggacctatataaatataatcatattattctactaacctttggcagttgttagatttttgtgattatcttgatgcacgatccttggaaatgttctcttgtagtcaacttgattaaagtatttgcttaaatcatcgtaaattcgaagccacattttttaaataattttggatgttcaaagaagcaatggattatgattattatttaaaaaattaatgtcatatattttctgaattagtgctatatgcttctttatttttttttacgtttttcaattttttaagcaaaaaggtatgtttcttttatcaaaaaaactttaaaaatttgtggccgctgggattcaagcccaggtctcctcggccacaacgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcacaatatattcacaaattatcacatcatcaaatcttgcaaccttccttcagacggtcatcaaccttttgccttcatgcatcaaaactttagaaaagacgttattctgaaataatccatggacattgtgatgtattctgatggaagtaataaatactttttctggtgatattatcggatatggaattttaacaaaatatgctatcccattttatttttaaattttcataatttcttcaaaaattattttgagttgcagacagtggttcaaagcttggaccgtggattcctaggcccacattctggggaatatggccaacagtataaccaggcctattccgaggcccatattctatggccatgagaaaaaattaaaaaaaaaaatttgttcaacgcgtgcggtgcgcgaatgcgtgcactatacgtggtgattggctcacgcacgtagctgagtagaaaaaaaaaatttttttttctacaccgttatctcattgtgtgagtcaacatcgcggatgatgtacaaaaaaatttctcaaaatcaaaagcatggacgcatccgtcccactttgtccagcagtctaacctaaacacacatctcgggactaaattaatcctatgaacattccaagctaataagaaacgggtgacggaacagtgcaactaaacgtcaattatctcctaatcccactttagctgaaagaagaataaacctaatcacccaccaaaacctgcaattgcgcctgaatccagaacacgaatgctcgtaaaattccaaaaagtgagatacccacgtcacgtcagtggccaagctagaaacttcaacttggcaatcgcaatacgagaggaagtggggataggtctgtcaacattgtgaaggaaacgcagcgaattccttttctcaagggaatttatatatttctatcagccatgctgtcaccttgtcctattattattatatattttatatggtcttcgtctgcgtgggaaagcacttgggtccgagtcgaaagtgaccgtagaagcacaaactgaaaagaaacggggcataaaataattcagtgcaccgcaagatgtgcttccttcactgcccccacttggaacgccaagtgtcatctgtcgtcctgcagattttggtttccttaaatgtgtataaataggagcacctgagcgattgattggaaccgaccagaggtggagtctttgggtggtagctttgtctgcactcgttcatattttcattcgattttgcctctctctctctctggtaattatgtgatgcctcactggtgtttgggctgaaaatgatttctgtttccttcctgggtcttctcttgatttttgatgagttttttctttttaaattttgtatggttttctttgtgtcgatgaattctatggaattgctcgtttgtttgctctcttgatgttttctatttagtttctctggaatactagtcactctgtgcgaacaatggttacattaggttatttaataataaactagcctttatacagattaatcggttgaatatctcgcttgtctccatcctctccattttgtccaaaaaaaaaaagaataattgtgttgttcagattctcagttcgaagttataatattaattttacatttccttcttctccttcttctttcagttcattctcacaatttccctgtcatgtatttggtcaaatgctcccctttcttaattagcagtttgtttacttgtttaccggttttcatccggtagaattccagtacaagtcacacagtgatgtcgagtatctctttttagctatgtttcttctttgaatggaatactttctgccattgttacagtgaattagccctgaggatctacttacttgtatgacctgaaatttccttccctatggacctcaatctaagaccacacatgaatgtggccttgttcatggatggagagagtattttcggtgtataactttggttgcatgttgttttgaataatgttttaaatcttgacgagaaggaaataaagaaaggaagggagaaaggttaaaaaaaaaaaggggaaaaaagaagaagaaaaaggtaggaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaatgcgagagaaaccgatggagaatatctctcagaactgctatcgagatggggtgggatagtggagcatctagttctgtggagaaacaacgacaccctatcccacaggttttaaaaccttgaatttcactttattctcgcgttcatgaagctaatcgttttcatgcgattcttgcaggattaaaattcttcgatggattgtgctggtactggagccaagtatgagtgcttgctcttcggtaagctaagacccgaggggttatactttgaaatttcaacaaagttcagcgagaagggaaaagaaaacgtatttgtggaaatttcccttcttctttgcaccacgatttattagttggaataagttctgtaatttcatggtgatttaatatcattgtttcttctcttttgaggggataactgaccgactctttgtttcatatccctagatatggatgataccttgtatcccttaagtttcggcctcaacttagcctgtcggaagaacatacaaggtgagctcaagaaaccttgtgattcacaggtttattatctgaatcgcttgtccagaggaccagaataagtcttgtttaaacaaagggactcattcatcaacaaatcatctattgctacttttgcgaaagaataaatgattagtctacagctagcaaggtatcatgtcaatatcaaagccactgaaccatgttaaaccacagattacatgctacaccatctccaaattgaagaaagccaagtccctaagatgtgcatggaattgtacaaggaatatggaacaacaatggccggtctaaaggtacaacttgttgcttgtcactgaacccttatttaagctagtttataatgcttcggatttctacccatggttcttgttgatattaaatatcttatttttgtttgttctgttctgcccttccttacaggcactgggattcaaatttgacaatgacgaattccattcatatgttcatggccggttgccatacgagatattgagacctgatcccatgttgaagaatctgcttctttcaataccccaacgaaaaatagtatgcaaatctgcaaatgaattctttgattttcaaggagtatttttttttaaaaaaaacataaaggaactatagatcatcttagaaaaggttggaatatgagaatctgtaattctgtatccccactagtggaatgattaaagtgtccaacaagcagcactgtttttacttatgatacacacactgcattaacatgtaaaaaaggagtattagatccttttggactaccatattaattactggttgatgcctttgtgcagatctttacaaatgctgacgaagcgcatgtcgagaaagttcttagtaagctgggtctagaagactgttttgaaggtgtaatatgcttcgaaactctcaatccacctcttaaacctaccgaccatcatgatgagaaggatattactgtgccttcaactgttattcagtctatgggtcaaaatggtgatggatgtttcagtgaaaccaattcagagactgatacaatttattgtgccgatccaagtaatgcgaattccaatatgccaattctctgcaaaccctctatggaagccatcaaagctgcaatcaagcttgcagatataaatcccaggaaaacagtaagtcgacttgaatttgagatcttgtgtttgattttgtgatgtatctgaacatattggaactaattgtttcctgctcttagatctttttcgatgacagcaccagaaacatcgcagcaggaaaggcagcaggccttcacactgtcattgtaagtggatgctttcctttataaactccaaggaggctgcaattcctgtttatgaaactcattgtaaaaatatttgtaaaaactactaaaagcttatctgttgtcgattctttcgctcggccaaacaattgtgaagttatcctcatataaccgacttgatcctaaaatctaatcaatgtttcacagacttttcaatttatttgcaacttattcaataagtagtatcaactagaaattaataattgtggctaaattgttggaagtgatctttgtttgtattttttttttttcctgcttttgccttgcatgtttattgcaagtaaatgtatccataaatcagtggtttattctctatttttttcattcttttgtaattttagttatccaattctttccccagaaaactttattctctgttttttgttcttttatagttctatattatctgtttctttctgaacttttgtcaacttgttatcattgttccaaatttctattcctcgcctctggcagtattgtatgggaatatcgaactttaggctattaccgaaattatacttttccctgaagaagtaagtagtagtactctatttgatctagaagcgacagtttttttttttttggaacgatacccactattttagacatgggcctcctctgagggcaagtattagaggatataattgacgcaagataatgatgtcgagtgtgcactaatgctcatctaccgataaacaccgcaagatgttcgatcctacaactccaggcctgctattgtattcagaaatatgttttcatggagtgcaggttgggagctcggtgctagttccaggagccgatcacgcactcaggagcatccacaacattaaagaagcattgcctgagatatgggagggtggagatgattccaaatcagttcttgcatccacaacagtcgagactatagttcttgcttgagcgtactctatatgttgccttttccccaatattgattgcatgtaacgttggagatttgtaagttgtatctagcatacatgaaagaaaatttaagtgaatggcaagttggatcgagaatgccaactggtgaggatgcatgattcaccatctatcaatttccttatctcttcatttttaacaaagtcctttttttttttcattccattttttggtcttttatgcttcatcaagcatgcactttgttgagactgaacttgtatggtagaaacttttttgaaaccctgagacctgagtaggccgagagagactcttggctacgaggactagacttgttagggtccgttcggttcggtatcacttttgttcaaaaaattgggaagaagaagaaggaggagaaaatttttatcaaaaaaaataataattttgagaagaaaaatgggctagattagaaaattcgttttccgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctgaccgcttgtgctaccctctggccactcgcaccgtcccccaactgctgctccacgccgccggcaccgcaccccgacgctcgccccctccgtttgccaaaaaaaaggaatatgattataaatgtgtgcaggatatttttggaaaggcattctgagcggattagagacgttcttcggctgtgcacggtgaagtagtgcttctcgagcagtcagcggggaaggaagaaggaagaagaaaattttggggagaagatttagataggatagttatcgtattaaaagtgagggtatttttatctcacgaggaatttaaagttaaacatcaaattttaatggactgaaagttatattttggaccaataggacttaaatattaaagtccgatcacaaaatccccgatttcttatctatgtaacccaccaatggttaattgtgggtttttccttttcttatttgttcctttactcctttcacttcctacctcactttgtttttttattcttcccatattttactccgtaaatatcaggttattggataaattttgggtggctgtgtgcctctcttaaacctcaaaaaaaaaaaactactatatcattgccggttgaccttgaaaaagaaaagaaaaataaggaggggagaagaaaaagccggcctgttctctccgcttgtcaagagagaaattaataatacaaaatattagtacaacgtataaaaatagagcaaaaaatacaatacagaggcacaagggctctcagatcggtggggtttaatgagatcttcggggagggcttggttaattgaggtcaacacgatcagattttgggtcggacttgggtcttaattttcagcatccttgggggagtggaccgagtggtacagggcctacgcctcctagatattttcaaaaaaaccaaaatatttcagggaaaaaaatatctcaagtgagccgcgagtggagccgggaggagatgctgtgttcagcagtgactcaatcaccgtcctctttcccccgtcctccccatcccttctccttcaccgggaagcatctctcccatgccttcttcttcttctcctccaccaaccccaagaccgtcttcgctcgccccttcagactctcccttctttctaaatcctcatccgagccgatcggatccactcctccttcctcgccggaagacgcccttgaggatcccaagccggaacccgatctcgaatccgtctccgacgacgacggtggtgatggtagcttccagatcgagatcgagaagctggagaagaagaatgggcggagaatccgggccagaatccgggtggaggcggacctggagacggtgtggcgcgtcctcaccgactacgagggcctcgccgacttcatccccagcctgaccgtcagccagttgatcgagaagaaggacaaattcgtccggctctatcaggtaatcaatttcgtgtgctgaaaaaaaaaaaatcatttttctctaattttatgatacaaaatcgtgaactttacttgattttttcctgatagatatgccacaaagttacccaatattttatgaccaatttgaggaggccgactatgaagtcgtgaactttactcgatttctcttatatgcatgtgacaaacttatgaaatttataattcaatttgaggaatttcgtacacggtggcgtggaacttcatggcaattcgacaaaagtatgtgaacttcacttgatttctctgtgtatgtcataaagttacgaaagttaccatagttttacgaaatttagtaggtttcggacttagtaatttgacagaactgtgaggtcatgaactttgcttgatctctctatcgatatgccacgtggtttctgtttgcaaattacaatcataacaaagattctagtaggtttcggacttagcaatttgacaactttatatgtattaactcatggactttacttgatttctctgtagatgtgaaacaaaattatgaattttcattggaaggcattaggtttggtatggaatttcgggaaaatctatcaaagttttattcttgaagacatcaagtttactaatttctccgtggatatgttatagatttatgaactttaccatttcgtggaggaatgcagaagatttggaatggaatttcttagcaatttgaaatagaagttagaaaaattgctgaatgaaagtttttggaacaggttggtcagcaggacctggcacttggtttgaaattcaatgccaatggggtgctagattgctatgaaagagatcttgagatcttaccttttggtcggaagagggatattgaatttaaaatggtggaaggtgacttccatacctttgaaggaaaatggtccattgaacaggtctgcatctcttgccaattgtttcatttttctgggaactttattcttttgagatcatgccttttgttaggtgtttaagaacctttcactcagcaaactactaaaaccagtagaaagcaatgtgttgtaaagaggctcttttttttaaaaaaaaaaaaaaaaaatttcttttataacaacagaagagttgatagatcaaaaaggaaggtaataaaataagagatagagggtgaatagtagaataaaatctgtccctttttcaagggaaatctaggaggcctgcctcgttcatctcgatgtcataaaaagttcttcctaaaacatgagatattgagataggacatcgtgcttcttttttcttccctaaagtccgatggccctgcatcttcacattaggacctgagcaatacaaatttgtatagaagatagacaagtagattttgctgagaaatccttcaatagtcccttaatattttcatcatgtaatccaacttttgttttttttttgggctgtttgaacttagctgaagccccaagcagatcatacccaaaaaaccaacaacaacaacgagaataaaaagatattcacattacattcattgcttttgctcctagaggaagcattttgtctaagacctattgttacatctcctccaagagagatcatgtgacacgcacaagtagcataatgacatgcccaaatattacttgattttagagaataatcataatgtgctagccactgggacaaacttatgatcctccagttgggcataatctgcaatcaagttaaccatggtcattagcacttggtaatgaccaatttcttccactttgttagttcacaagtgtctcctttggtggccagatttaggaagtaccaatgattgaatttcatagcgaaaatctccatttgaagttatttcatgctaatatcatgctcttgtacttgtatcgacatcttgacacttctggccaatgcttcacttgcattttatgtcgtcagtatattctcaaatctcaaaccattttgcaatggccaaagccaatgttgcttaattatataatattattatactacaagtgctgttgactacagccaccatatatggattttataaaagaaatcaaccacaagattcacaatactgtggtttccttttaaattgaaaattatattatatttcaaagcctctttgacaaaacctccattttctcttgatagcttgtaatgatttgagttatttatatgaacaatgaatatctgttcaagcaaacttattatcccattttagctcttatttggaagattagccaatctattttatgtactggatattgggaaacaaagatatttttggtctattgataatctgcaaaaaataataacttcaagattttttttgtggcatgatatactaaattttacttaatagtagccaaatacaattaccatctcaactgtggccgagaggtgagtggcatggcagctgggtgtgaaaagaagaagaagagaggagcaaaataggaaggcagaaatcatgaattcataataagaacatgcatagaaaccaagttggttggtttactacaaatcccaaaacctaattgagtccaattgctatcggtatctggcttatccagcgccaattcaggcgagaacgagttgacatttgaccatcctcttttatctaaggttataaactatttatggtagatttcgtgaaacctgagggagtaccatctttctttgattttgtgtctctggaattattccctagcatcagcactggttctcatttatcactttgggctgtgtatctccagtatcatatattcttgtggaatatggcaagtatggctagtcgaaaataaaattctatttcaagctaaatgttgtgacacagaagaaaacaaaaatcagcagacaaaaagaaaattgcttgctgacatcattatgcagctaccacgccagtcagattttgtgtatttagtcaatgtaagatttatataatgctattggctttttcagtttttggatcctttaggtgtccgaggtttgcctgcacctttgattgttttaggtaaatgttactgtctccttcatcttaaccataggaaccttaagtaacaaaccggacatgcttatgactaggaaaacccaagctgcaggcaagaattctttggacactgttttagacataatcttctgtaattaccgtttagacataaattcctgctacgggataattatatatttttaacctaggctataaaataagctaaaatgttttttttttttgagggtaaaaataaaccaaaatgcaaacctggggtatatgcagattgatggtgatatgtgcaaagacgatgaaaatatggttgggaaaggattccagacaacactattatatttcgtagagttggagccaaagctttgggtgcctgtgcgcttactcgaagggcgtgtgtgcagagagatcaaaattaaccttcaaagtattcgagaagaagcccaaagagttcaagaagtgggacatgaggcgcttcctacctggtaaaagcagcaacattctccgtttgttttgtgtgttgttatgttctgcaaatctatctatgagaacttcatttgttgtttagcatttttagggtgcaaacatttcctggtaagcttatgattcctacatcaacgcatatagttcctcttgaactagtcagttgctatagactagatcccaatgttcaccccaccaaatgagcccatacagttgaagcttcctatgatcgttttgccgatcaagtcttctgtccttgaagtcttcacttgacggatatcagtgtcgtttcttgtaacaacgacttctacttaccacccacatgtattcttcaaatgcaagccatttttccagaccaaccaaggattctctttaactgttcacttcaagaaagccaggtcagatatccctggcctccctcatggccccaccttttttatcaactgttttagtttttaattccatggataagctgcctcttaccatgtggatgatgcagatgaaacttttgaggccatctttagactgtgcgtctgatggagtgtgttaattcagtgattgggtgggagatctggtcaaaattatagcctgaaatcacaagagctcaatactctggcatcatttactgcagaaaattaattagtggatgaacttttacttctaaaggaaaacttatttatttttcttcttttccatttgaaataaaagaaaagtagtctataccatttgcgatgcttgatgatgctttgaagttttgttttctcaaaccaggcatgacttcatgaaaattagtagtgtgcggtgagctctcatggtatggttcgtgtgtaggctgtagtgtcataaaagctctcgagagatggttttattataattggtcaaggaagctgggagaaacagagaatgctaccagtctgactagttgaaggagaagctgatcaaggacaaaggagcagttctaaagcagcacagggccgaacagaaagtcttgtgcttttgtggtgcaacaagctataaatttaaatgaagtcctatgatgacagaagcgtccaaactggtccttccaaagatcgatgtaggcaatggaaagatgagcacagcgatcctatcatatatataccttgcaaaaaataattatttacggctttcccctttctttttttgtgtatcatgaaaagtgattctttttcctactcttttccatctgtgaaccagtaatattttttcttgttgattgaataccgattgaaagttcagggatttgtggtcaagaacggcttgttgttaattgaaaaaaggccaccagcatctgtgattggtcggacaaattggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgctgtgcttgtatccgattccaaaaccacctctttctgtgtgcttcttccgagatccatacttggagcaaagtttggcccatctccatagttctaacagaccttttatgaaactcaagagtttctatcctttaagcttgtttgtttttgttttttcttttctctttcttgagacatgtagtttgcgcgtgtgggaagaagaattacgatgatattgcattgtattgcctgccccccttgacaatttaagatgatagtcttgtccccttcatccttagtcccaactttattaaacttgagtgacaaatgaaacattcttaactgctcatgaatgggaaagtccaagctgcacgcatgaattgttttggcatgcatattagtaataatttggcataatttgctagtcccacaaatgccagacgcattatgaaattcctatggttttggaattaaagtacatgctaacttggagtctcaagattgacaacaatatgtgtgacgacatggagattttgtcggagtgaggattatcaactttctcctatgtcatagagttggagccaaagctttggtggtctatgcacctacttgaaggttgactttggatggaggtcatcagaatcagcattccaagtgtttgagaagatgctcaaagagtccagactaaagggggtagggcacttcttggtaacaagagcaacattctccatttggttgtgtgtatctttctagattaattgttgatggatgctttccaaagtcatagataatttctccacattggttgcctatataagtcaagtgtttgcgagcgacgcaaattggctttgtgcgtttgctttgcttttgggggggtgcttttgtgcgtaaaatttatctgctaattttatgattgttatttcaaatctgcagttcaacctgaaattttcattctatccaaaaaaaaaaaaaggaacttcatattgtcctcggacctgataatcccatgcagttgaagctttttatgatcatttgacataaaaagtcttctaccgcttgcataaaaattataatatatatatatattttgcctgcccacatggccccacctgtctggatatatgctgcaacttgccaggtggaagatataaatcaaatctatgaggctatctataggtgttcttcgctgattggtgggaagtgtggtcaaaaaaaataacctgaaatgaccatcgctcggtattgtggtatgcttcacttcaaaagtaactagtagatgaaacttatgaccttttacttttataaagggtagaattttattcgctatcttgtagaaaaaaaatgtagtccatatgcttgctgatcgtcccccctaaaaaagggggaaaaaaaaaggtagttttctcgaaccaagcatgatgacctcatgaaagttgacaagctgtgggatgggccttgctagtctttagcatcacaaaagcttctgagagatggactgcatcgagaatagagaaaatgatgccgacttcactggttaggaggagaagcacatcaaggtgtgaggtgaagtagaggccggtcgaaacctcaggaacaattccaaacagctcagcagtcagcactgaaaagaaaagattactgcatgctctgttgatgatgcaatgagccatcagttataaatggagaccttttgcgactgtagcataggtcactggttctttccagacacctacatagaggtgcttgtcaggacaacaacaacttggtgactgcaatcatattgaagtatatatctttgtgaaaactaaccctttacagataccaagtgtgattttggccaccccaaaaacaaaaaaaaaaaaaaggaaagaaagaaagaaaagcttttcttttgggtaacatgaagctggaaaagggtcaaagtatctcacgaatctcaaattattcaaagtttctcaacagcgggttgtacaatctataagagacgtccattacttaatcgatcgtccaaggtaaagtgagatgtaagcctatctttgttactaacatgtccggttttgggcctgctgaaggtaaagatgacacgggctaacttattgggtataataattattattatgtataaagtcttaagtggatgtcgtaacttccaattgacctcttctgagaaggccaataactagtgttagttgtgaatggtcccaactgccatgttttgccaccgcagtggaacaatattctttatttcttttctgtttattaacataaattgatgtggctggaaaggcaagtaggttcctggtatgctctctcttttatgaacttgagagttatacatacgatgagcaggtccgtcattacagcaatggtagattgggatattggatcttagcactcgaatccccgtttggggccagttccaagaaaattcagtggcagggacaagtacgtactctgactcaagcccatgtattaaattccccaaccgcaactgcgctgagttcataaaaagccctgtagttggggttcccacctaatccatccttcattaccgccacaatgcctctggaggatgaaactaatccctctggtccttcatttttgcgattcattctcttctttaagcatgtcatcagttattgtcatacttgttttctagttgagtaatgagccggacctcggggggcaagatttaattgtgggtgacatgacatggtccgatcctcacgacaaaggggaaggggtgcattcaaaagagtacgtaggtgccttgcgtccgacttggattcaattgaaaggagctcaaggcgtgaggggcttttttcctgttattattatttcagcacaaatcctcgatggtgtgtaggccgtactacagtcagtgatgactgccatcaatcaaaagatggacggccatcggacaatatgagccgtgtataacatggtacatgcttgttattttctgatggattggtgcaaggttgtgtggcctcgggcggttttgtaattaagcgtaaaccaaatatgttggacatatgtacggcgtttgagaatgtggtccgagggcaacattgttcatcttccccaaatttgtggggaaagttattttgtgtacatcacatttattgcaaaccgttctccatatattttgtatcattatatagaatccttgatcccatccatggtttgaaaataacaacggtcaataatggcgattataaccgtttgaaagccctcacctccataaatttcatatttgttatatagaatagaacgagcatctagagagatgaagcaggaggacgatcggatgcagctcatgaacggtcttgggaagtttgcaataaaaggaatggagattttctaattaattttctcacatcgcatatggtagaatagatctcagtgtcatgcattaacttattccctccgtgaaggaataattttttaaaggagtggttaagtaatttgaggatagaaatagaagtaataaaaaaatatacatagaagaggaaagggcactgtgcgcatagaagaagacgaagaagaaggagaaaatttacccgaggagcaatgaaaacaagtaaatttatatgtggtcaaaagtcttccaagtggatggcaagtcagcagtcccatgcaaaagcacgtgcatgtccttgctaacaccgcagcctcacgtgctgtaaatctaaattagcaacccgatggatggggcaggtaaaaagaaaaaggtccggagacagagagagtgagagatgggagggattctaaagaggtagacagagtctgatgtcacgctagtgacatccaaaggccaaagagcaaagcagagaaagctctcatggctgactcttcggtaaaacagtaaccgacaactacactaaactgttcttgtgacccaatttcagagaaaggattggattcttgtggagatgtttaacttctccaaccccatcactatcgatctaccccaccacaccgcgggcccgcagtataaagaaagtggccctaatattcattcatgtgatttaattaaccaagtggtcctatcaaaaaaaaaaaaagtaggcctaaaaagggtttgagaaatcaaattaggctttagaaacttggaggctctttttttaaaccgtatatgtttctggttccgggtcttgtttttcaaattagatactttgatggagctgttctttggggttgggtgactgaaacaacgacaagagtcctttttttttttttttggcacatagactcatatcacatgagactaagatttttgactattaattttctttccattcttcatgactttttttgggggaaaaaaaaaatttgacatctatagacaattatgttggtgttacacccgagtatcttgttctcgataatcaatgccaccgagtctctaaaaccctctgaaaagcgactactctaatacctgagcaggacaaacacatacggctataaacatcaagagtacttcaacaatgtcgattctcttctcctttctttccccgtccatggaatgaaaggtgatcttgagattatttgagctaatctccgccttgaggagcaaagaaaaaaaaaaaaaataaaataatatatatatatatatatatatatatatatatattttgacaatagtgtaaaaaagtttcatccatcaacataatgatatatttttttgataaaaaagttaaaaaaaattaattatagtaaaatgaaaatgtcaaattgataattttgaagagaacatgaaaatattttttttgaagtcaacttgataaacttaggtaacttttaccgagactctaaataattgtaggtacatattagtcatacaatgtcatttgtgcaaggaggtgccactaaaatctggcccaacctaattatgctgtaaggtgttttacttgatctgcaaggttatgggtctataaaaaatatcgcatcgagcttgaaatgataaagtggatccataaaaaaaaaagaaaggacgagcactaaagattgctggattttggcgagcaataaccactctcatgttatgcatgttataggacttaattgcatgaaacgtacactcatgagtcgagtaggaatagccatatgtcggatgagctttaattgcctttatacaagttttagtggaggcatatagcaaattttcattggttggtctaataagattagcaacagtgaaggtgcatcagaggttaaatatttatctacttcttgctcttttctctccaatacctttgtttcattcaatactgtattttttaaaaaaatatataaaatgagggtgaatagtggacaactgaaaaaataaccatgggatagaacaaaaatcacatggggcgggcactataaaagatcatatgggatggacttcataatgtaccatgtgtcccttaatactaatgtttaagtatgagtctaaaagttaaagactttttctattgataaagttattagttccataattaaagcattctctttcttcctcgttttcagcatatagcgatacatattatacgactatattgtacatacttaatatataaccaggtaatatatactatagatttttcgatatacatccagcaacaatctaatatacacttacagctaaattgatacatgatttactgaacttaatattcattagtacatagtatataactagttgatacacatttagtaaaatattcatccagcatttcaatatacacatctagataaatcgatacataatttttaaaatatagtatttatcagtacacagtatatgaacaaatgatacacactaaatagcttattgatacatatataaacttttttaatgcacatctagcaatgacctaatactcacctcgaggctttttcttctcttccaaatccttcttcttttctaaaatttttgtatgtaaaaatttaccaaaactatgtatcatttcacctagaggtgtatattgggacgtcggatgaatattttgctaggtgtgtattaactgatcatgtactatgtattagtgaatactaagttcgataaattatgtatcaatttatttgcaggtgtgtattagattgttattgagtttgcatcaaaaaaatctctaatatgtatcaacaagccatctggtgtatattattggttcatatactatgtattgataaatactgtattttaaaaattatgtatcgctttatctagaggtgtgtattgggatgttgagtgaatattttgctagatatgtatcaattagtcatatactgtatactggtgaatattaagttcagtaaaccatgtattaatttagctataggtgttattggatcgttattggatgtgtatcaaaaaagtttacattatgtatcacatggttatatattaaatgtgtatcatatgattatatagtatgtatcgctatgtgctgaaaataagaaaaaaaaagagaatactttaattatgaaactaataattttgtccgtagaaaaaatctttaatttttagatttatattttaagattagtattaagagatatatggtacattgtgaagctcacccatatgatcttgcctgccccatcccatatgatttttgttccatggtatgtggcaaggtgcaggaaatatgttgcttatgaatcgcggccatttattaacatttcttcccaggatgtaaacagatgtcctcagagagcttattgcctaaattttaggggagacagaacggttaagcgcaattcactacgaagaaacttggagcataaaccgaaacatggacagcacgagacgagacgagagaatatttccaacggtggggataatccaattccaggggtatcacgaaagaccaccaaattaataatgtcttagttttggactcggtcagtctggggcgggggatgccaacctccaaccactttttccaggtactattatatgattaatggtttgtccacacctccttggaaatttgcttcttggtaggaggaaatcatggtctccggtgttgaaaagaggactcggggggcgttcgtctttagattattaattagtcaaacccagagagagatcgatgggtttggtgcttgtggagtcggtctccagtggggccgcccacccccttggcttggcttggcttggatgctttcgtgccccgaggcttcacgtcatggtccccagccaaatctatccatataaaaatcatgtgctcatgcatgtatgattgcatgtacatacatgttcgcaatcatatacatgtcagcctgagccatgagatttttcattcattcgagatgaaaatagatggccatatacggattattgttattatttatttttaaattttgttttatgagatactaatattgtttccttttaagctcttcgtgaaagttagacttgatctagtgaccaatgaatgaggagcaatcatggaaatgttgcagaggcacgtgtcagagaccatccgcttaaaatttatccaaataatgataaatatttcaaagaaacttgaggaggaaaccagtgggccttcatccccttttccctctcatatcccggcgaccatcaggggctctaactcacccaccatcccatcatcaccttcgtcgcctctgtcatgccaccttggggtggcgaatagatggagtaccctctagacccaagggagggcagcctcgggatcaaattaaagatgactctattttgataatgcgtctgcggcagttcaatatatgatgaaataagtttggagtgctcaaaatggtgaaataattagttacgacgaggagatcttgggatacaatatatggggatttccttccttctttttttttttttttggccagagaaacagtacatagggatttcaagcgtttgcgtcgtgatcatgccaaaatttaaatatattaatcatgcagcactggcactaattcataaatagttcacaatccaggatgctagaaattgcaatcgaactattttaatttcgaacatttatttatatcggccaggatcaaatcttaaatagtcctgatataaaacgaagggacatgatctcatccaacatatgtttgaggctggagctttgcacatgtaatttgcacttgggatgcaggttaaccaaaagtgccaagtcagttatggaagtaacctcatcctttttgtatttcatgcacgtctcgacctcagggatattatcatatttatcatttgctatttcatgcaggtgaaaaaaaatacatgattgaatattttaactagaattctcgggatctccaacatttaaaactatacttaacaaataaaattttaaataatcttaaataccatgtggaaatgaagcggatgactttcacaacgaaatctgataatttcattggattttatattttaggcatttccaacctgcacgtttgacatgatgcataggttaattttgatctttgatttggatcggttgatatttattttttttgcgagcagtctccaatcccatatctttttgagctgcataaaacaaacatcaatatatatatatatatatatatattattttttatgttagatttcaaaattttaaatattataaaatgatctcttatataaaattatttgtggaattttgtctgaaatctttgagatggcaatgtggggttggattctttatgtagacggccattgcacacttgcatgattttaagaaaagatttatctacgtttgggcatcttaaaatatgaaggaaaaaaaaaaaaaaggaaagtccacccactccatccatttcatgggcgcgatcatgatggtgacgatgatgatgtgatgaccgagtgcattggggcagctattttgttattatatttatattgaaagatagtttttaatttgacccttaaatccaatcatgcaagaggaaaagaagaagacagaagaccgattgtaaattccccaaaccaaagcccccctcattcccactttcaactcccaatctccagacactctctcttttaccctcccaaaccatttgaaaactccgagaaagagacccctccctgacggggatgaagtgaactcactctcccctctcccttctcctcctcgcttccccccaaaacaaacacccacccatctatctctttcctctggatccaaacaaaaacccccatttcatccttcccatccccttctcaccttcctttctctcgtcccagctgcctcctttccttcaagatctccgcgaaggcgtcgcctttcctcccctttccctctccccggcctcccttcctcgccgttttctatcttcttctcgcaggattcgccagttgtgcgcctggatctgctgtttgaggtgcttgatccagggatccgtgggagcttcgccggcgcttcgagaggagggcacatgatggccgctcgttttgctatatctctaatatttttctatgttttcggatccaagattttgtttttctagcctgggattgatccttggtggggttttgatgccgtagctgccgagctgctgcttatgatgcgaacgcactggaaaagggctcatagggttgagggattcttcggggtttcgtggccaccgcagtccgagctgagctgctggcttatggtgaagggccagagaaggccccccttccagagatctctcggtagagcactcgccggtggccggatggttatttctcggtgttagggaagtaggtaatggggaacagtacttctcgggtcgttggttgcttcgtgccgctaggtaatggaaaagagggggtcaatttggagtttttagagccccttgatgaaggattgggccattccttctgttatgttaggcctatgattgttgattcccctgccataaccccgtcaaattctgaaaggtatactgtagattcgtgcatcctcgattcggagacgcatagcggctcctttaggcaggagatagtcgaggatttggctgccggggtgcagagggtcaacaagaacttctccgagactttctttaaaaccatatcgggggcttcggtcagcgcaaatgcctcgactgctcggaccggcaatccaaagatgctgctctcaggcgatgcccaggagccggctgcttcgttcgagagcacggcgtcctttgctgcgatccctctccagccggtgccgcgcgggtctgggccattgaatggcttcatgtcgggacccttggagaggggatttgcttcagggcctctggagagaggggcgggtttcatgtcaggtcctttggacaaggctgctttcatgtccggtcctcttgacagtgctgataggagtaacttctcagctccacttgcttatggccggaggaggccgggatttggacggctcatgagaagcatgagtcggcccatgaagagcgcactctcaaagactttcacgaggcgctctcagggtcatcctggatggatgcagcggttcctcttgcatccgatgacgcagctggtgtggcattccaaggaggcaaagtttcgaccggaagctccacggagttgtgtggaggttgggccatccgaacccgagtacagcaatacacgtaatttgcagtgggctcatggcaaggccggagaggacagggtgcacgttgtgctgtctgaagagcaagggtggctatttgttgggatatatgatggtttcagcggccccgatgcacctgatttcttgatgagcaatctgtataaatctatagataaagagttggagggattgctatgggattatgaagacaagcctggaaaaagtgtaccttcatctggtcttattgaaaatgatggggttggggtttcttcggagtttgtaaaggaagaatgtgtaggttctcagttgcagcatgatgatttggaaaagcaaggtgaaaatccttctcaagcacatgatggatgctccaaaaagcagtgcaatgacggagttgtacctatccagtcaaacgaggatgcaactggtttggaaactacagtgaagaatgggtcaggtgaagcattcatggaagctgatgaaatagtagaggaaaaggatggatataaggacaatggctggctgcaaagtgaagctggccaagagtgtagcgcaaacatgggtgacagaaattcagaaacagcaagccatgtcaatgcaccggagagtgaagcctcctgcgttgcagcaaccaaattggcaagccaatgcagaaaaagcaagcgcctttatgagctgcttcagatggaactgctggaagattatggttccaacgagccatggttgggatcagaaatttggaagaagaggagttcctgggatttgcagtcaagtgccagtgaagacttgagtaccagagaaagcttaccaatggcacagcctgtttcttgctcttcaagtatcaaaggagaaagttcaggtcatgtggaagatgctggcagtccaagggaaagcgagggtgttttggggaaagattccagagattcaaagcacagatccgttgcttcattttctgctctgggacagaggcagatgatgaggagatcattgattgggtcaaaattgaggaaaatgtacagaaagcagaagtcattgcgtaagaaacttttcccctggagttatgattggcacagagatcagccccatgctgatgagagggtagttaacccgtcagtagtcgttaggagatgcaaattagggccagtggatcatgatgcagtgttgaaggcaatgtcacgggctcttgaagcaacagaggaagcttacatggaaatggtggaaaaggcgcttgataaaaatccagagcttgcactgatgggctcatgtgttcttgtgatgttgatgaaggatcaggatgtttatgtcatgaacctcggtgacagtcgtgtcatcttggcacaagacaggctaaatgatcgccatgctaaccaaaatcttgcaaaagatgatatgaggcaccgaaatcggtcaagggagtcacttgttcgtgtggagttagacaggatctcagaggagtctcctatgcataaccccaacagccgtgtctgcaacattaacaagaacagggaactctctctttgcagattaaagatgagggctgttcagctgtctactgaccacagtaccagcatcgaggaggtaactgataaatagttatgagttttatttgctttttccattagaagttcactctacctagttctcaatcaatctattacatagaacctggttaggatctgtgttgcaaatgccttaacgtatgtgcaaaatcacttgatatctttctgaaaatgcttatattttctaatcagtaagtgattgagaatatatcaaaatgctacatttgtttatattgttacataaactattgcaagcttgtttatggttgtagagaatccatgaagtttttgatcatggtgaattttcttcctgttttaatagattatggacatctgtatcatcatatttatagtacatgatattgttcatgataattattagcattgagtaatcttctatatctagcaattcttcacaccctgcctcccatttcctgcttaggtcaaaccgtataaataaatacttagccagtggtgctgaacttgtgcttctaattcattcttttgctgccagaaagcaatatttgaattaattctattaattctgtagttcttactggactcaataaactttcccagagagggaaaggtgatatattgaagaatttgtgttgtttcttctcaactccaggacctcttatcctctgactcttgtggatgtatttataccagagttgtatagtatatccgccctaacaaagaaaaggaaaaaaaggaaaaaagccgagtagatatacgtcttcttcattcaatctgctgtcatcccatatgcaggttttgtattgattttgatggtggttatatacactcatgaacaaaaatacgcacagttatcctgccattgtattgcaacataattttacttgtattttgctttttaaatcattattatgtatcacattcataaacaccatcacaacattgggttcattggaagttttcccaaacccctaggtactagagatagcaaaatgcgaactttaaattcaaactctttaattatctaaagccactcaaaggcttggagcttttcttttgagaaatcccttgttaatgttagttctgttttttggggaaatgctacaatgcatttattgttccatacacatatgagatgctctccattccttagctaacagacattctcgatcaaagaaaactctaaccagttggtaactgtttttgatgaaaggacaggtcaaaattgtgccttgttataaatatgaacaaaattagttctaataatgtagctcttggtctttttctcatctggtaggaggaagatatcttctttcaatctctggcccatctccttcgatgcccatcacaatgctgacttcttctctccactactcgtgtgtccctgctaaactgctgccatgttttctcccttcccccttcctttgcctccctctctagttgtcaaggaatttacgacaccaccaccaccactaccttgccactttggtgatcaaccaacctccactgcgatgccccctctccactgctccagcgcctgcagttcctcttccaatgctctgtctgatgatttggatcattgtcattacttagcgacactaattattcactgcctcaagccacccttttttctgtgctgccgctattgcgtcttttcaccaacattaccttgtcattcatactgtgtttacaggaccatgagcctggtccatttaatgcttcaccaccagatgtccaccaccgaagtggacacccacttatccactctggaaacttcaatgcaactggacgagccaaataatatagaggatgacaattctatccctatctgaaaatggaaattgcaaagcactatggctaaaaatatttaaaagtaccatagcaaaacccattgtcttgatcaccttcttttgtaacagccattactcatgatcctttttatttgagccaagtcttatgtccttgttctaattgagtcatgatgctggattgaataaagcttagcaatcttatatggtggttttactaaggactgaacatttctatagttacctatttttgagaaaaggtttatatatttagttattctctttccctttatattgacaaggtctaccaagctaaggtgtttgaccaagaaacaatctaacaatccaaaaaatatgtttaattcaatttaaatttaaggactttcactttgtagccataattgttcatgactatgaatcaatgtcctaactgtgtgggttagcttaatgagtatttacttattttaattgcacctgttgttaaatatggttgtttaaggcttgccttaccccacttcttgagccgaggctcaccagggagaccataaggctcatgcctggggctttggaaggattgctactcatgttacatagaagtcttgtctattttctttttgtgggaggcaggtccactaggctatgtatttcatatttgcttggagtattatatgcagtatggtggtaatgattcaaattaggtgacacttggtaaccttcttttgagacttgtgcacaatttacaaagtatacaacttgaaatctttaccaaagttcaaaaataccccaggttcaaacacaataatcatatccttaaccatgtcgtgtcagtggttctcttgtttcaagtattccttcatttaagaacgaggatccatggttcttacaccttatcctcgaggcttacatgcatcaagagtctaggggccttaccatacaacgcttgtttaaaacatggttaaacctacacctgtcaacaggtcaggttccgacccaaacctagcctaattaggttagttaaggtaagaattttgatccaattacttgattccacttgacaatgatcgtatggaagctggaatatagatatacatgtgactatgagtatagatatccatttattacaataattgataaattttatatacagccacaggatgaccagttattcattcattttgatgatttatccatccgaagctctttatatatctacttgttattgccttggcaaggtgggggcttacatatcatcaaagtctccttggtttattgaagatgtaacacttggaagggagaacttgtggcatatctctagatgcttgcttttttggctacaacttgactctaccgagtcttagaaccatgccattaccccctttcttgttacttaatggaaactcaaatttgacgtaccttaagtaacagtgaacaaggtttcagtgatgccattattcctgtatagtggatccttgacaaaactattattgagcaattaaacatttatcaaggctgttacttgatcttatctcgtgtgatttggggttaatattaaaatgttaactgtataatggccaccataatggcatcatataggaaaataatggagaaataatgttgttatttttgaaattattgtttactcacgaaaatatttttttgatgtacaaacttttttaagggaaaacttttgaaaatttgaactttgaaaaatattgttttattaagaaaacaatgtgaatgtcaaataacaactcttatttgtggtataatgggctgttgcaacagtacataaccttttacaattgctgttaactttccccattatacatatagttggacttggctatactcaagtggatctccatacagatccagttagttctatattggacaatgagggtcttacatctatgatccgagccattggatgtgctctactacttctaaagtgcttacataccaaaaatcatgtgattcagagacccctagcctatgcatcaagtgataaaaaaaaataaataatttagcattatttagactgtccatttttggacaaaatagggagataatgcagtgccctttaagagtgaagaagcgtaaaatttgggattatatcaagagaacataagagcaaggcatcaaggggtgaagatgttttgatgaaaaatcaatgtggcatcatttccatcacatccaatcaaggtttaagacatattttcatgttatataattagatggtgtattgcatattagtgtatttcatctttaattagtagtttaaaatttgtgtaagagagcaaaggaacttcttattctttcattttctttagttgcatgtgttgtctacaggaaaaggtatctttgttaaatacatatgcgccttttcttccttgatttttttttttggtaattcttgtggatctttgactgattaccacaagactactctggtcttttttatataataaaacaaacttctgactgaaattttggttgtcaccggccctcttgagttcattatcaaataagtgtgctttttaactaaatgcacctgccttaagttagctatccttctcttctctctatttaagagagagaagagtgaaaaactaccaataaaaagtaggaagctgatcaaaacctatcataatgaagttcataatatactttttatgtgcatctcacttttttattgttcgttgatctttttttgctaaggaatttggaattgatttgtagaacttcaaaatgagctacttgaacagtggcgaagcatttgaacttctagagaaacatgccctttaagagagacatttttgtcaactatttatgttggttttccttctgattaccctataaatagtataaaatatgaaaagtcccgtgagatgcatgccagttggtagcatgagtgtgcttgaagggtctgtatgcaatctgaatgggccttccattgatcaagaagtttccataaaatatttcaccatcagtgaatatcctattgatgcagaagaaaaccaaaaaaaaaagtaaagaaaagaaaatggaaactttgtctgtaaaaggcgacaaggcaaaatataaaagatgatttggcagattactttgccaatcaaagtttgccgtctctgtactgggccctgtactggtgccaatctattactgtgtcagtacgaagccggttcggcctatcgaatgtcagtacgcccccagactgcatactagtactgaattggtatggtacggtatgctctgtaccattcagtttagtatgcaataccttgcttccaatgttggtggacacatccacccaaaagtgacaaaccactggactctccaaagctctccaaacttcatagacatggtaaagcctccctgttctcttaccttacaatggtatatataagtatcatcataacgttggaataataaggccaaccaccatccaacttgattaattgttttcatagtaactacttatcatggaacttaaagagcatcttacaagttcaacacaatccaattcgagctgtttcttgataacatttcaaattagagaaatcttcattatatcttcttttttctaggtgtatgataaaactttcgctactattattaatacggacagtgatgcatgacaatcatgatgtcataagcttcatgtgcatcaggatgtaccggtaataatttgcctctatcacctgccaaaatgatagggaatttaatcatcaagggaaaaaataactcctcactacgagaatatggataatatgttacttagacaagacaaacatgctgatggtaaagtttcttgttgaatcctgtaggacttgcaatagtagctacggaatattcaatgtatatagagcatgctgaataagtagggtgttcactactgcaagtgatgatatcgggagagattgagagaaccaaactctctcatacatgttatgtccgttgtttttgagctaatatcaataactgaatgctattttccaactagtgatctaggttgagcagaggaagatgcaactaaaattgcatctattttttccctggagcatttagaatctccattcattaattacacctacttgaatagtggttccctttgagacaatcttcagtagtttgctatcatcgtacttcactagtctacatcctattgtagatgttgcccctcgatcatttgctacaagcttgttgaatgagggaaaaaataattgaattgtccacaactacaatatcttgtactctgctgataacagaaggaaataaggaggaaggtaatgaagaaacaagttttaatgtatgttttggagcaataaaacaatgctcaagaagcttcttggagttatcttgcaaagagtttgtccaactgtaactcctatggattctacttgaaatgaagaagaggacatttaatatactatgttttttcataaaggttattgcacaaggacgcctagtatataaagcatgtactggaagtagctgcagaaacttttagtctttacaaataatgtgtgaccctgaagatgaatatgatatcagatgccatgtgtcttggttcaaaaaggtaataagtgtgaaatgtaaaagttgttgttttgcttctccattatttttaaaagatacacattataagtttatgttgttgtgttgtacttttgcattagttggataggctttgtctctatgggtgagtacaccatgcatgctggcactataagcaccttcactcttagaaagagttaactcttatgaatgcctttggagtaatttcatccaaacctgcacctattctaatatgtagtaccaactttcccaatatgtctgttggtgaggcatttccatctgtccatgtttttctcccctgcatctccaatttgcatttcccatactgtatctgtgtctttttcaagaccataaaggcaacccagatagttgggaaaaggctagatggttatggttatgagcttgcagtttactttatttttgaaagaatgtgtgcatcgcatgtgccatggtccagtaaaaagtaatttgatgattgccaaaccttagacacaaaagggcatcaccctgaaaataactgtttaagatctaaagagtacatggatctctttttctccctcctccccactgtacataaaaatatgtgaacattgcataaatggcttcatgagccaaatgcacctatttacctagaagctcttcattctttatcatatatagtctgttaattactacttctagaagcagcttaatgcttgactgtataccctggttatgtctcatcgtttatgcaaattctgcaggaagttctgagaattaaagcagaacatgctgatgatcctcaagctgtgttaaatgatagagtaaaagggcagttgaaagttactagagcatttggtgcagggtttctgaagaaggttagcagaaacactatgcttttaaatagggtccacatgcatttctttttttttttccctttttttttgtttgatacatatagaccaatatttttaatttatttatttgtttatgaggcacattatcagttggccctgagctgaagatacagtgcaacaagttgcatggttttgcgatatgtttcttatattttgttttccatttattttatgaaaaattgacatgaacatatcagaaaattcaacttatgaaagctcttcaaaacatactagttataactgtaaatttattttcttgtgctcattttctgataaatttgatctcagagtctaacatttaaacctttgagttgattttttaggaatgtacaaaaccaaaaatatgaaagtgagaaatatgggttgcactgcatagctaaattctagaacccctctgcttgagcagccctataatctgccaatcaattttcttttcatattttattctgctcctttctattggcttttgcatggtttttgtgaattttgatctcccactaccattcattttcaaaataaggattaagtaaatcataaactcttttctagaatataataaggcttcaaatcttagacttggacttattcactttatgtattaattattaaaatttgagtatctcagaaactggtaaagttttacaaagttcattattctatctgcaatgccataataaaattttgaattggaatgactgtaattgccttgctgttcttgttgggctgcagttcaacaattgcaaagctttggcctgtccttctgccgactatggctttccaatctaattgtgctctagctaaatgacaaaagaaaagggaaaaaaactggcctctctttcactctcagagggaagggggcatatttacacaaaaactcctaggaccacttcattttttattccaagatccacttcttcccatctggacgacttgttagtggctcaataatctcaaagagaggcctcagtagcaaacaaggtggtcttgttttttcagagaaaaatgctcagaatgtgatcacagatatggcttaagcaagccatgcatctgaaagagagttgttctaaggaatgggggttttattaaagtaacttataatagaccactgtttccaacattggattgtgaagtggactagaattgttcttccaagaaatgacaagctcttctatgtcatgccaaccacatcgaaaaactatgcactaggaaaattttgcgatgtcagaaatacttccttttaggtatcaatatgagatattttgtcatggcgtgttcctgcccagaaacaatggtagcatgcttgtttgttcaactattgttgataatgaattagtggacatgctgattctcttattgaagtactaaaggcgtacatggccatcactctattacgttggtgatatgatggcaaaggcaatagaacaaacacttagtattgtatggagaatgcttaagccatgcaaactctaaattaaaggactctatggagcatgaatatgtcaaactgcacactatgtctatgttggatatttattggatactgatagttgtcagatgcttcatagaaaggatttgactggtcgactctataacactatataactaacagacagggggcattatacacacttatgcactcctgattcaccctctgtgaatgcccacatggactttgctgtaggctatgttacctgaagcagtctgtaggttttctgtgtgggctcactgcattgctgcaggaagacatgatccaatgtatgggtctttatactttacaaaaatggttgattgaaatgccatagcttggagaatcagtagaatttctgaatttgtgaatagagtggaggacgtttgatactgagtagaatatttctattgcccaccatttatggtcgtattagtgggcctgtcaagtgatcacttgtagatttggaaacttgtgaaaaggccttattactgagcagccaggaaaattacgtttgcaagctgattttgttacaacttgtgtgatcattgtactcagtaaagttctttggggttatgaatggaattatggaaaggattggtccgatattcaggataatttaattcaataccaaatcgaaaacattagaatgatgatattaaattgtatccagaaaagaagcatgcataatttgaaataactaaatttgagaaaagcaatgcaatgcaccaatcagcagctttttatctccaaatgacaaaacattttaaagaatgagatgttaaaatttgtttgcctatcaaagattatgttttagagattgatatctttgatagaagaatgttggattgtccctaagaggcacaaattagaaccagcaatgcttatgaggttgagcttttataaggctttgacaaatctagtcctcaatgtccagaggtggttaagtagaagctttttctcatgttgggttttgggaagcaaattcatctccacaatgaaatgctattgggggcttttttttttttttttaatgaataggtgattggttcccaatttaatgcttagtgaaggaagatcttatattctactgaagctgcatggttcatgaaggaagttagaatattgattacaaagttgttgcccattgcagatcatgtaacaatttacttgagcatgagttctttctaattctgtgtgtttaatttgagctaagcctgccaaaatgttgttttaggacctataggtgtgtggaatggatcgagactaatttaggataattggactgtttactggtttgtttcaaaactgatttgatgttataataagtggactatggtctatggagtaggcttgaaattctgagcatttatgaggggtgttaatgtcctctgctagggaacattcagcgagttgtgatctcttctagtgggagtccaaattgcattttaaatcatcaaaacaaagcttttctagatgataagctgagcagggcatgcttttatccggcttgtttgttaagtatgagtcttaaaatagactccagttcaagaaattagtacatataagagactcaaacgcagcatttctcaatatataggaaaaaggtgcttactttgtcatgtaacctatccttgtatattcttaatgaaaaacagctcacatcttcgtatcttgtttgtgtgcatttgttataatctctttgttctcatcgtctgctatagttttggtcagatatcatgttagaaactttggatgtgattttctatttaattttgagttaacacttggaacatatcctcaattcctgaggaatgatacaaatctataatcttcacgggaaacaaaaattaaaagagaaggaaagcaaaagaaactgaatagcaaaatcaggaatgagtagaccaaaagggagaaatagaaaatcactgattgtttatgtgcaatttcttaaaattctataggtgtctggagtattctgatgaagtttcgcatgtcagattatttttctgataggtaatgttgggaatccaagattgtctcatgatgcattggaaggcggcaggacttaagattcttctcagactgatttgaatttacttgtcaaattgttgttttccttcttattacttcagtttttagtgggtttattgggaaacaaaggcagaggttaaaaatctcagattttgttagatagtttattgggggtagcaatgtcattcatggcatttctcactacagttactgtgaacaagtaacaatgccttatgggggatatttttgggattacaaacaaattgttagggtttctatgcttataaactcagctcttagagttatgtaatcagatttatatggaagaagaaaaggtgaatgaaaaattcggtgtccttttctgtcctgtggtgtgagccttagaagaagcaggatgcttgcaacccaacttgtgattcttaggtcacacagagagactgatattatccctctctgctctttacttctctgtttattctacagttgggtatcttctgctcttctttctctctttcttaccttaccttttggtttcactccactagctttgaaaaaagaatcctggcatctttatttcctgctctaccatttccgtttatcaacaagccccccttgcagcaatctgctgatactaggaccagcaaacagtcctttaaaatctggtcatagatgagatccaatcagtcctgctacaatatccagtgatgtgatgtttaatcaccgaattgcttctgcttgataccaagaccaattaatcctaactccagttggatgcttgatctgcacaagaaaaaaaaaactattgttttcgctgatgtgtgatgtaacagttattcttctgaattttctactgcttgttcactttctagaacatgcctcttccctattaatgctcagcaacatttatcgttttcttccttccaaaatccctagttagtacttatgtctaggctgtcctactggtatcatagcaaagaactctaggaatttgagcagtatggtggtgcattttgctggtgagtggtgaaatagaatactattgtatgttctgcatttactattagtcactaatagagaaaaactagaaacgtgacatttcattagttatgagcaggatcaaagatgccaaaagaaatgtacgtcctaaaccttgaatactggaatatggtggattactgatccagaaggccctagtacttgatttataaaatcttatgtgattaataaaaattgtttgaaaaaaagattttaatgcaaaggttttattccttcttttgtatgtatatggaggatgatttaccaatgtcttagatgtccagggtttataaaactgaagattctaagaaagatgtagatttggttaccatataattgttggatgtttgaaacttaaatctactcatagattctagtattatgttgccaaaagtatggcaggtattaaagttagaagcaaatggtaggtgctgaagaaaggagagtcgatgctagatcttgaactcttgacaatggataataggtaatagagacaaatggaacaaaaagaattgaagacggcagagggaagagttcctaaatcttaagatattaaaccttttgaactatttacttatgactagtggtgttcagacaacagcagtgtcctcctaggtaactgcttgggtattgtgttgcaaagaatgattggcaaatttgggcatgattttcccacctgacatgaccggtttaaagttggttaggcatgtttgtttgttgatcttgtacaagttaggcatgaatgtttcacctactaacttgtttgagttttaataatgaggaagaaataaattacattacaaaatgtaacttttcttcttcccttaaccaagtaattcatatgattgactctcagattttcttttcttagtaatgagatttaccaagggcatgagcattttggaatatgagactacaaaattacgtacctcatcacacagcaagcttgtgacctatggacaacaacctaaacaagagtatccgaatgttattatctgatcattgtctttttattgttttggagtttaatttcaattttttgtcaagttctttcagtttggtgaacaacactatgtatattgatcaatgatgtcaaagacgtctaaaggtgcatctcaagcgctcaggtgaggcgtcagaaggggtcattgcctcttgatgcttcaggcgatgccccttcactcaggcgcacgcctttgatgccttatagggcctttcttagtgagacgaggcgcttgcctctggcgtctcagtgaactctataattattttttttaatggttgaaaagtgtaaaaaaaatctaaaaggccattcatttaactttttagctctattactaataagggataaagtggtcaattaagatggcaaagttagtcttaaagagatagaggctgattcagatgagacaaaagaagatgttgaaggatataaatccaatgaaggaggagaaaatgaaagtaatgacaactatgcaagtggaattgaatttgatgattccattgatgaactttaggtgttaggactgtttatcttttttgtttcatttatatgattctactttagagctgtttatattttttattttatttataagattccattgatgaattttagagcttgttatgttttctgtttcattcatgaatttagagctgcctatggcatattatcatatactttatcttgaactagttgagtattttactgttttatatatgtttcatgcttaaattgttaattatatggtaattcatattacaatagttatctttagttgttatttatttatatatcatattttctatttttttcttcaattttaacactttacttcattcgtacggatgcttttctagtgcctctcgcctcaaggtgctagattccccaagcgccttaagggtgtctttcgcctttgactaccttgatattgattgcttagaccttgtgtggcctttagttgaccttatcttgacatctagctttgtcattcaaccccttgtgctacatgaagataaactgcaatttgcaaatctattcttttaagtcataaggggttaatatacctgacttgtttgtgttttggtttggaaaactgctcacatttggtttatcgttttaaaatacataatttattaacttcggctaatgttggtgggtttctaatttttctagatgtagattgtactaaatttgtaatgagggcagtcaccttgaatctaattcagtaggatagtccaaataagttttcagattgggcatattgttggaattgtttatgtactgacattctgtgactggttttctgataatgaacattacaaatcctcatgcaaatgttgaattgtcgaaacgaacccatgcagaaagaaaggaaagatggagttgcacattgactatgtccaagatccacgtctatgtctatgcaaatggcacagtgtagagcaagcttgatatggtcattaaaactttctccctaaatcccatatttatgatggaacttgaatttttttcttgggatactgaatagatcaaataaagtattcctgtttgtccccccccccccccccccccacacaattttttcttttcaaaacactgattgaatgtcatgaaaagaaagtgtaaagcagtgttgattaatgaaggacatcggtcttatattaaaagtggtcttgcatgatttgttgatccatctggaaataaatgtgacaatggtttttgcagtgttgtctatcttcattgctaatggactatgagcagtcgttgatgtgcatgatgatgatcattgggattgactttgctatccacactcttaatttataatttggccatagttacaattaaaggcttaagagttttaactgttcatttattgtgtcatgtgattaaagtgtgccctatgagattaaagtaactctttttctcaaaactgccatgtgaaagaggagttgcagttctttgaatttgttatggcgctggtgtatcgacctcggtctctgcaaggttgctagaaattgctctttctggtggttcttgcttttagagcaatgagctatattcaaggttttaggccaagtaggggattgaaggtgaagctctcatcttatcttatataatgtgcattcttgaagggccatgctcttaatttgctgtcatatccattatgtaagatgaatttttttcctgaaatttctaagagttgaatactcttgaactaagatggatgctttaatatgtgtttctcctaaaagaaaatgttgaaaatgtagaaataggttgtgtttaaaattctagtgttttaatcctgtgttacaggcaaaggacttgataaccatgttacccttattttaagttttcctttagttttgctagattgatgaaaagttgtttttgtgggactgattgtgctggtcttttccttctgatatagccaaagttcaatgaagctttgctggagatgtttcggattgactacgttggaacctcaccatatgttagctgcattccctcagttcttcatcaccgtctctgctcaaatgatcgcttcttagtcctttcatctgatgggctttaccaatatttcagcaatgaagaggtggttgcacatgtgtcgtggtttatggaaaatgtaccagagggagaccctgcacaatacctgatagctgagctgctttttcgtgcagctaagaagaatggttagtggatttgacatcatatgtttttttttaatcattaaaaatctttcaattctagaccactttttgattgattgtggaggtgtcagtttttcgtaaaggtaatcatgtgatttctgattctcactgaatatcatttttctcccttaaagtgcagtcaccgagatgcaagtgtgatcaattcctccacaatatcttagcattgatcgagttattttttgagcatcctggcaactcagaccaaaaccaaaaccctcaaactttatcccagtgagattcatcaatattcatccggacaaacatctacatcctccatcaccatcaatttttaagtctctgtcaaagtcttcgtctaagttaccttaggtatcgtttccaatttattttcacagctcacttgtctaaataacccatcattgcaaatgcgtgacaccctcattgttgaagctttgcctgatttttgttgcacgtcatgtttactcaggatacagacagttaccaataagttcttttgccattgatagtttacagtctagcagtctttaaattgcaaatgcattttttcacgtacatgcaacatcttgcatcatgttatggaaacatccagccatgaacagttattctgatttcatgcaataacgattgtgaagcttttgggtccctaataccgtaatgattggaatgcatgtttggttttcatattctctctgcaggaatggactttcatgaattgctggatattccacatggtgatcgccggaagtatcatgatgatgtttctgtgatggtgatttcccttgagggaaggatttggagatcgtcaggttgatcactgcactttgtgaatttgtgtccatccactcatgtatcaaatttacatcaaggaaggccttttgtttccttcatgagctctctcttccttcccccgcaccacccaccaccacttccttccccctccccccctgcttactcttttccttcaggtgagctccgagttacaaacatttgtgctggccatcgctatttacctctctgtgcatgtgctgtcatccaattcattggccactttaaggattaccatggtcttttcagtcatttgatcaatttaattcatggatatcaagagtctatccactggatggctgtgatgcaatgaattaagccatgctgggcatttgcatcaatgaaagatctgaattgaaaagaaagtccccaagtaacctgttttctttcttcatttttgtttttatttttatatttttctatgatggtgccatggacaatttattgatattgtgaaatcattatactgaaacagagtggccatctgcccaaccgttctcgaatatcaagttggtaaatatacaatttttgatggaccaaacggtaatgcgtttatcccatttttagccattttatttttggactgttgcaaaaggtaagataaacaagaaagggcatgtccgtttaacatatttaggttgttggcgattaacattcacatggattgcaggtaaaaccttatgagggtattgcattggttagccaattctcctatggctaaattccagatattgctgaattgtgcttggatcaggctgaaaaaaattgatagaactcaagggaacattggtatggttgttgaacaagtagtagatgaagcacctaggttaattttcaatatgtgagtagctatttgatgccgtatctagataagttctttagggcgacgctgttaggctgcctttggtttgggtttacaagaaaggttaagtaaactcaaggcacctttacaatcatttgtaacgtgtcaagcattaacgatgtgactctaagggcaaagtgaaacttgtaaaatgatgtcaattttagtttttccacctaaccctgagatatctatttcactccgtagggtgtagtttatgctgtagtggattagatgcaacttaatccatttagttggaagatggcatgttttgaaaccaaatggtgactaattgggattaatctatttatctaggcttagtcatacaatagcattatcaagattggttgtctcgatgtccagtcttatattggtatcatattggtattggtattgcttggtttggagtcggtaaattgtacaggcacttggtatctccttcgtctcagttcgataccagtacggtctgatatgttcagatggtgtgcgtcaatatgggaaactatgagcatgaacctcataagaatatcttacccgttattttttattccatctgcatagggcttattttatctgcataaggccatggggaaaaggatctacaagcattgtacaaataaatcgaaagaagttgatgattttgaagaacaaatcaaatattatgatgacattagtacagcatcaattgctatgtattctgggtgacaaaggtcaaactctaaggctgcatttggaagcagaatacgagggagtaacagtgatttaactctgttattttatctttttctaaacaaacatttaatggagcaattagattacatcactttcaaaaggtaaaataggtatttccaaaaactacaaaatttttccttctaatccattcacctcactatatccaagaataagtgaaagcttgaatttcttggtaaagaattattctcccccttggtcttggaccagtctatttagttgcttattctcctactgcggcagcattagaggggaagagacagaagatgctgatggtttgcaggttgtccagggatgcactggggaggtcgagaagtcgcccccttcatttttcattgggttttagacttggtcttatctcagttgcttttgatttttggaagattctgagttgtaatctttaagacatgctaaaaccctgtgtacaatggggggttggcttagttttgcggcttgttttgaactatggtgtttgatggacttgagctacagctgggtgtgcaggaatgctggcttcttcttctctactctgaccaatatgccctagttggagtggcccaactttcttgatgctctcttctgcttccatttcttttgtttcttcttccattctctgtttttaattttcctctcgtcctcggcttctcttccggctgttagtatcatttcattgacatcctcaccatctttgtcaaaagcattagcatcttgctaacttcatgggaatgtcatgattacaagatatactacgaggataataaatgatgacaaggattgtcttgacaattttggagagtgaagtgcaaaacatagctaggtaagccgtgtctagagttggtttgtgctagtgttttgcatgggttgctaactgttgcacttagacaaggcctaatcttacgattatgaatgcctttaataagaacattggtttctagaaattctctttatctgtaaacccataaaaaggaataatttataaattataagtacagaaatctaatattgattaacattgtcaacttaattacaaaaacaattgagcttagaagtagatgtttcaagttggagtcttggacaacatagaaattgaccaagaaagaaggtgacaagcaagctgaacatggccccaagcaggcccaaggtctgtcgggctaagttggtttgcggcaagcattggacatgggttgagaaagtttaccctaacatagcttgccccataaccctaaccagttatcctgctccccttgcaatcccatgctatctccaactcactcccatcccatctctctctctctctctctcgccccccacccctactggaagcttcccatcgcatctcttcttttcttcaatccctcttccctcgttctctcaccattcaaccctcatcaccgcctcctttttttttttttaatcccttctcttctggttcctttttgatctcaatcaatcttaatctatagtttctgatgcttttaattcactctaattaaaaatgttgtttcttaaggcttctatctccttaatctgatcgcatctagatttttgctattcgaatgtaccctcccaaggttggtctcaagataagtatgtgtgcttcgacacaggaaatcacaatcaccattatgagatagtatcctccttaataatgagtcgtagtaagagatttttaatatggtctatttctacaagaagcaccacttcctcttgggctggcaatttttgatacaattcttttacttgacctgatttatagattttgtttgccaccataactatttatagcattataatttatggacaagttttatcttttaaatactatgttagtactagtacgtcgctgtttgtattaatgctggctatttatatcatcataattttaatgttagctttatgattctacataatttatatattttttgtgcatagaatatacatatatatatatatatatatatatatatatatattnnnnnnnnnnnnnnnnnnnnatatacatatatatatatatatatatatatatatatatttatatttaaaaaaattcccgcacatagtctttgctggttacaatggtagagctggaggaaaagtaaaaaataattttcactcctccattacctcttatattttgtggactaaaaaataaaaataataaattttatatatgtatatatatagtatgaatacggcaccggtggccgtctttatgctatttgaactgcgtcgggaacatgagaacagacggctaggataccacgtgcgcgtggcatgggagaatccgaatttggcgaccgagatagagagagagaaaaaaaaaaccctcgcttatatgcataccatcgcaccaatttgagttttggctgcggacccgaaccctctccgagcgccgaaggagagaatccgcagcgatgttcggttctaccagttgtacgtctcacgctcccttgcctctcctcaagattcgatttcttggttccttctcttagatttctacgattctttttttctttcagcaagaatctcactcgagtttgtgagagatcttctttctttctgatttgaatttcttggttttgtttgtgtctttggtgcggcttttgggttgattgggcaatggagggttttgcatcgacggtgggattcaaatagtggaggtaggaatcttgatagatgcgacgttccttgatgttttgctagtaaaaaaaaataaagtaaaaaaagggcaactttacttgggggaaacaattctttcttgatttgcttcagacaatgacgatgcattttaaggcctgacgcaatgtatgcctgatacaaacattagaagttgaaatcttgaaaggtgttctgcttcctttgttttgctttgaaaataatggaaactttagcgtaacctttatagttgagctcgttgttggactctgttgatccgaagtacaggtcttcttgcttattttgttatactttttcagtcttatgggccctttttcttgttgaaatcctgcaaactggatgctgtttctcttcttatttgatttaggtatcatctttttgtccctgaggagcggatttggctagtttacaatgtttgagcaacgtgtgatgatttatttttcagcttttctgatggatctatcctgtcatgcagcttttgggcagtcatccacgagcccgtttggttcacaatcggtgattgggcagacaagcagtgctagcagcaatccttttgcgcagaaaccctttggtagtccaaatccttttggttctgcgacagggagttcagtatttgggggcacatcaactggtgtctttggccagccttccacaccggcatttggtgcttcatcatcaccagcttttggaagttcaacacctgcttttggagcatcgtcagctcctgcttttggcgcttcttctgcttcctttggtggttagtgcttgcttaaattcatagcacttgggttgatccatgcccttggtttcatttatacactgttttgtgtaatttaagtcaagtactatggtttttgaatttatgtgcaactttgttttggtttcttccatgaggttcatgctacctttttttggtagggctttttatgttggctgtccttaatcatttcattagacagagcatttgagttatcagtctgaagctatgaaccattaaactactagagtttgttgatgaagatatagtacttcctgactggaattttggaatggaaaccattcacatttgcagctagaagttaatggatatttcttgtgactttaataaactgtatttatcccgtttgatcttttctctgtgtcatttctcttcttttagtcttcctgcaagaattgaagttaaacttctagtgttccctctccagttacagatttagattcttgaagctgtatcccacctatgtggttgcttgaagtctatatcgttgctcattatttttaagctagattttacctattaagggtggtaatcaaaattggctgcctgagcaagcatgaaaatgggatagaatgtgaaggatttttgttgctcttgcagtgaaacctccctacaatatagacaaacaactatcatcaaaatataaacaagacaaaatccaatttttgtaaactatgaccttcttccttgatacacatgtacattcatacatatgtatacattcaaaggtataacacacagatatgtacacgcagatatgtatacatacatatgcacacatgtataaaaattgtaaactactaattgttgctaagggtcaaattatgctttacattgtcaggagatacttaacgggttgccataacaagttacattaggaaatcggaatttcttgcaccatatgctgtcttgtaaatgagacacttgaagaagatatatatgaaacatcaaagggtatccctactgtagtcacttaaatggtttttcccaactagatttttccctcctctttcttcctgaattgcttgaatcatagccattccacttttaatgataagcaacagtgcatgtggtcatctggatggatgactgtgcaagctaccaaattttagattgtattgctgatgctcaatttgattcccatcttctgaattgctcctgagatcttgccgacacaacttcaaccaatagggagcttaccatgaaaccatgaagaaacattacaatgtaggaagttgaccttagtgattagtctataactctatatataagctcatgtaaaaggaacacatctttctaaagtcctccaaactagtttgtggagaaactttttagaaacttctggttagcagcaggctaggtcagatatgcatcagtagatgtgaggaacttggactaacaagcggtcaaaatgttgtagaaaagaaaaaaaatccaactacttgttgatttgcagcatgtacagttacatgtgctaatgtataggataattattttagctaaaagggatttcagttatatgcatcagcattccaatctagtaggagttgaatatgactttatctagacacagttatggagtgttttttggtacatatgtgagaccatgtagtatgatttccaataattgtcaaaactggtgcgatgtaccagtacatcagtacctgttttaaatcattccacctgaatgtgggctagcatgctacttataactttgcgtgtctctgtaatatatttactttaaatgctagcaaagaaaacacgaaaaggtcctttcttaatacatgcatccaaaagtactaatctatattagtggttcgatctcacccaattagtcacgctagtagggaagaaatctgtttaactagttttgcttatttttaaatcatgtaaggattccttttttttaaaagcaagtgttaactagtactaggtaatatgcaattgcaaactccaaatggtattttcttccttatttctatctctaaactgtaaccgccatgaatcctcttaaaatctatgctatattttttcatgttccattcaaatctcctttgataaatatcttttctactttgggaatctcttgaattagtccatccatctcctccaaaagtgttgctttgtaccatcatttaaccctccttgtcgagcataaacactaaggatattaatatgttcttctctcttactctctcatcttgtaaattcttatttacatcaattcctaccaaggattcaagatatggtgggacatcccatggaacaccaagaaggggtaccagggtttgccatatcgggccgaaccgcctagtatggggcgtgttgaaccatcccggcggagaatcgagacggttccggcatgcaaaacggtacatgccgttgccaggaagaaaaagagaggaagagagagaaatagagagagagagggaggaaggaagaaaaagaagaaaagagatccgccggaggccctccggcgagcagccgtggccgtcgggtggcggaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttttttaaaaaaaaatacgagaaacaggggcggatcgcccccgttccccgcgctgatccgcgggaggccgttccgccgtccgatggccatggctgtccgtcggagggcctccgacggccccttcggcggatctccttccttctttttcttccttcctccctctctctctatttctctctttttctttcccgattttcttcgtcggttcgcctcggttcggaacggaatgaaggcgtgccgtatcgtaccgccggctggccgatcaggccatcggtaccggtacagaaaatcttgaggggtaccattccaagtgccaggacaggaccgtcctgccattgtctcagcatcccaattgacacattccagcatcctgtcgttgtcctattgtccctattgtctcaagtgtcgagatagggcgggacagtgatgcatcttcattccatgaaaaaattaggacaaccccgtttgatgggattttaaatcttgatttctactccatttttattctgttctttcaagtataccaaagtttataacctatcttaccaaattcttttgccttttctccgattcatttagttttttgcatgtgagctatgcttcttctcctcctagtcattttatctattagttataccgattttcctgtcaaggaccccctattccaagttactaaatgtatcctacttcttggattaacttctttactgatgcccatccattaaagtgtgagaatccttgcctacttcccatcacatcaaggcaccgatgtggcacgttgcttctaatgaattctttggttaacccttgttcactttctgctacactccatgtcagttgtagcgtgtcgctaatagggaatactgatgttcataggatctgactctagctttatgttggctatcaagttaccgcaaccctacttattgggcttgagactgaatacaaaacataggcggagttttagggacactatagtaagaaagctaataaatctgaatttctttgaaaaccaatattgcaatacttccatcgctttgcacaacttggtccttatcttaagaaagttcttctcagaatcaaaataaataatcaaatggaaagaattaacagaaatagcacatatacataataatagtgactcaaaatcttgaaaaagtttccagtttcggttttgccatttcaagcaaaacttaagagcattggatggtcatagaaatcttgttgagagtgcaaatttcaggctgtaactctgttttttgttctgggtggtgttaacatcccttttccttctataggaactccatcttttgttggtaaattaggttgatgttattccttgacctcttctttttctctttgatatgcagaaaattactactcaatctatagtgagttactggatacgcactcttgttctaatatcttgctatagtgtcctaattgaacatggatttgactggtcctataaatttgtcaagagattttgctatgtcactattggccccctatgccatagctcccactaaatattacaaaaaataaatgtgctgggttacatataatacatgcaaaagatgtcttaattgatgttgaaataataatgtgaggcatagctgaagcttcttatattttcttgatcatttgttacaattgttgcaaaaagtttctatttttctgaaaggaatttttttttcttgaaaaataattatcattcttgaagaggagatacttcaaactatgagcagatagatgaatatcaaggcttctgaaaagaagtagaccttcagtgtatttatttcttttcaagtttttatctggtctatttgatttggattactctacatctgatcaaaggcatttgatctgaatatctaagtttttcactttagatttggaattctacttcaagcatattaagcactgtaaactttgttccttttttctcttttcttttccattttcccatacttaatgttggtgacctttttggcattaacatgtttctgttgacttattgtcctttcttatatttattattttaacaaaagaaagatcattctactctcttctaggatcctctgtgtttgggcagaagccaccttttggaggttttgggtcaactgtcaaccagaccaatccatttgggcagcagacacagcctgcatttggaaacaacctttttggttcagctacgccctttggtgcatcaagccaacccacatttggggctactagtgcaccggcttttggttctacaagcacccctacttttggttctacaagcagccctgcatttggagctacagctgctcctacatttggtgccacaactgctccagcatttggtgccacaacatcaccagcatttgggtctacaacaactccactatttggcagtactggagctgcatttggggcatcaagcacccctgcatttggttccacagctacaccagcctttggtactcaaagttcttcagtgtttggatcttcaaacactccagcatttggtgcatccactactcccacgtttggatcttctacggcacctgcttttggtgcatcaactactccttcctttggctttggctcctcaccatcttttggtcaatcatcttctgcatttggcagcactccatttggaactactacatcaccttttggtgctcaaagctcctcatttggtgaggttctatctgtcatgcctcatgttgaatgcagctacttaaaatgagtatatgaaaagaaattttctcataagccagagccttcataaatcatcttacattacggagaatactgcaatagtccatatcttgttttcttcttccttcttttgctcttcccacaatttttaaaataacttttaattgttcttatatgacttttgaaggtactcaaacagcaacacctgcatttggtagcccaagttttggacaagcagcttttgggggccaacgggggggcactaggttagtagcttacagcccaacacctgagactgatggcactagtggcacacaagctgctggaaagctggaatcggtatcagctatgcctgcatacaaggaaaaaagtcatgacgagttgagatgggaggactatcagcttggagataaaggtggaaagtatattctttagctttgtcacatactttaatgtaattttaggcctttggtggtcatgcacctgagtcaccatgaagtatttatggagaaagcacaaaggaatataaaataggcacattaagttttcagcttaggcttaaacacctcattatagtttctatgtggaaaacagaaattgctcttgcttttagcaataatacaattgaaatttctgaataaggaaatgcctgcaagcaatcttcttgaatagacataccttggagttagaaatactctatgcaagtgttctggtttttatatctaactgttgactggaaggtgattgcttttgtttctaggtgataatcactagcataaaagcagtagccttgtggcttttcatgcacctattctattgatttaataattttttttctttcggatgtatattatgtcatagatttagctacaatcctacctagaggatttatttcttaattcaattagttggatacacataagtctcatattgtatatcacaatatggatactaaattgcctaaagatgaacaatcacccaaaattctacatgtgcatctctttaatacaaaaaaaaaaaaaaggatgtgtgataagaaattttgtttagatttattttctggaaatatccaaacacattgcatttttttttaagttttaagatgtgtggataatgatgaatgctggggattcgagtaatacggcctattatgcatgttagcacctttcctctacaggtaatgtccatgttatttttctgactagtaccaagaaacttctgaaacagttgatttgtggatttcgacacttttaagtgttgtagaataatccatggtatatattctaaatttggtggcctgtttggatggttgggcccaaaatcctatgggattcatggcccaaccaacaacaatactgaattataggctgggtttggcctattttacagcagtccaggatgttgggtcttttttttctccctatggaatttggaccagctactgaaaaggtggtcttggatagttgtaaaatagaccaaacccagcccataattctgtatttttggtggttggccacgaatcccataggattttgggcccaaccatccaaacaggcccttagataacttgtgtttccgactaatagattaaggctcgaattttcttaataagtttgtagttcatctctaaactttttttgtttttgcaagtaacatgcccatcatatgaccagctctatcatgacaaatttcttaacttcattctatattaacagtttcttttgtgactgactggatgagaataattttagttataaatgatagactacatgaaacttgatatagttaatttattttatttatgtagttgatgccaacaccaccagcatgtgttagcaatcatggtcttttaggttgcattctgacacaattttgagtatttgttgaggtttctctggtagtatgttcttattttcactcttacatttcattgttaaaatattacatttcagggggtccaaatcctgctggacagcctgctggagggactagttttcctgctgcaacacaacctagcccatttggttctccgggcacatttagtcagcctacaggaaaccccttttcttcatcaacatcttccaacccctttgggcctaaaactgctacttttggacagactggctttggatcctcatcgtcttcaatttttacctcatctctcaatgcttcctcttctagcccttttggctcaacctctactaccacttcattgtttggggcttctagtggttctgcttttggttcaagttcatctcctgcactttttggaggatcttctgcacctgctttcagttcttcatcctcgatttttggtgcctctggggctgggtcatgtccagcatttggttctggcctctcttttgggaacactcaatcaactggattgttccaatccacttcatccgttgggcaaacaccatctccttttggtcagtctgctacaggatttcaattgactactcctagttctggatcaaatctatttagcacaccatcaactggatttgggggaagtttgttcaccaattcagctccggcagttctttcagcgagcaatcctgttggttttggtcaagcaactgtaagtcactatagaaattctgttgttaattccagtttttcgactgtgtgcttccatttcttattctctatatccaccatgttgttagtgcatttgtatgccctattctgctgatcttttttggaagttttaaggaattaagcttctcctgcagccttctctttcaactgtattcccgcaaaccgccccttctcagacatctagtgcactttcttttggcaactttggtcaggcacagccaggtaattcacttgtgttgtgctttctctcttttattgcaactaatatttcaaggtattacagacgtgttattattgatatctcagcatcttcaggtggcttggccaacacatcaagtatcttcagtcagggcaccttcgctcaaccgtaaaatccaattcctgtcctgttctttaatgtaaattattaaataaatgtaaatagggttaaaggggtctaaaaaaattcagttctgtgagattgttgacacctgtatgtgtcatggattctgattatgtttaaatgctaccgtctcgttgtagcatctttcaaaaccagtaaaaacttgatgttctttagagttgtttctgacttcttacattgagctgtcagttattctttttgaaaaatcgataatgatattacatgttatggggtcttgataagcctgttgacctattttaaagacttgaaaatttatgattgaatgctgtattaagtgcaaggtaccttatcattgctattgatccggccttctcttttttaaatttttgtttctttcacacgttttccctaatccacttttatctgtttatttcatcttgcaatgaattaactattctttttctgattatttatttgttcaatgtgccaatgctgcacagcagagctgctactcagtctgctattgttgtgcaaccagcaccagttaccaatccttttggaatgcttccagcaacacctcagatgtccattggtcgtgtgggttctgcaccttcaattcagtatgggatttctacaatgcctgtaagcttactttcttcaagcctctgtatgtaaaaggggaaatcagtccatgtgattatctagtagattctacacacgtttcactaatttatttgtcccttttctataatcaaagaaacattaatatgcatcttgtggactaggtgcacaagctttgttaactgatttgtttgcttcctagtaggttgctgaagtgtctgttccagtcagaatctcctctttattggctcccaggcacatgtctcagagaaggattaggttgccagcaaggaaatatcatcctaaaagtgatggtctaagggtgagaacattttgtagttccactttttctataatttctttggcctgacaatcacaaacccgaggacttctaagagaagttgactgtttcttttccccagacatgctagtttcttgattattatatttagtgcttacaacatgcaagaacactacttgctcagttagcatctctgtgcaggtaccattcttcagtgatgacgaagaagcatccaccacacctaaagcagatgcttttgttattccacgggagaatcctagagcactagttgtccgtccagttgaacagtggccttcaagatctactacagacaagcagtttgggctgaaaatcacacctccttcagcgaatgaaaatggtataatatgactttgtgctgcatatgtaattgcctacgtgcatttgccagtaaatatagttacataagtatttttaatctattaccatgaacattgaagtttatatcaaaacacgacttttgcttgaatgaaaactggaacacttgattggtcactagagaactttattatttgatcaagccagacccatgactgaactcatcccaatgttcaagtagcaatattgattggcatggttaatgtgtcatcttatttcctgggtttatactttattagctatcgtcgttggttcctgtatcagggtctacagcatagtgataaacgttgtccaaaccttcactgtcacaatccaccccagttttcattaatcccaaacccaccccttcatgttttcctgacatgaattccagcttatccgatgcagtgccatctcagatcagctaatcatctttttatgtgcacaaggttggataatttgtcctctttagaaggtgctcctctgacttaatgagaagccttcagcgaatgacttctgagaaattgatatcattattatcggtcagtatcgtacgtctagcatcatctccaccttgtagccatcataaccaccatttcccttcggtatattctgctacttgtgcaccttccttgctgctacctatctgccttgaccaccccaccaccgttttcaatgtttggctgcagcaccaccgccagtagcttgctgccactacaaacttatccagttaccattggttctcatttattttctcctccctaggactaccagtgtctcaatgttactctgctaccgaagtgtgaaaattggctgctccaactactctgctgaatataatttgtttcagtatattttgttcagatttgggttctatctttcacttttctgcaataaataaagtgcttctcaaaatcaactatcaacccatttcagttaggttcacgcactggaagtgacctgtcagttcaataatgtgattagaccaataaaatcctaatcaaaataatgccagaatttacttatcagtaatcatccgaaatgatagtgttatgttgctttaagtcaggtcatgaagagcatgaggaacataaagtttttttaggatgattttctacctaatgataagggtaaaatggctttcttgtaatttgcattacaataatggcaaatgtcattggtaggtagttggagccgcatgttccccttttcaaagtcttcttctaatttcatcaatggagaagaaagagttaatgtaacttgtacagagttccttttctaatcaggaacacttgcactgtaacatgtttcggatgctagaaatttaaaattcttttagtagctggagccacacgtttccctctaattcttctaattttatcaatggagagaatagtgcaagtataacttgtacagggatccttttctagctgggtacacttgcactgtcacatgttttgcatgctagaaatttaagattcttttaaaccaccttcttcatcttcttgatcctttttgcatgctggaaagttaagattcttgtagaccttattgatcctttttgcatgctagaaagttaagattcttctagaccttattgatcctttttgcatgctagcaagttaagattgttctagaccttttagggtgtaacaatcttctttttcttcttcaaatttcatcaagggggaagaaaggctaaaagcattacttgcacagagatccttttctaaccggatgcactgtcacatgtctggcatgccagaaatttaagattctttagaccctttttttttctacttcttctgcttctgcttcttccaatttcgtcaatggagaagaaaaagttataatctgcacagagatctttttctaacaaggatacagttgcactatcgcatgttttgcatgctaaaatgttgagattctttcagacctttttgtggtgcaacaatctatcataagtcgtctggtggcacaagtgagacccttttctaaccacatgtactgtcacatgttatgcacgctagaaagtcaaaattctttttgaccattgtggagtaacaatctatcataagatatttaaactcgtcaatgccagcattaatgtctgctcccaactcaccttgacattgttacaatgtagggagtccggctgacaatgggcacaaccagcaacaaaatagaaatcacctatcaccatccaaagattccaaaccttcccagaagctgaatgggtttcatgctgaccgtgcagaaaaggcgagtcgtttgtcacccacaaacttctcctggcatggggctggtgaagctgcatttgtgtatgagcatggtgcagatattgatgctctggtgcccaagcttcatcatgccgaatattacactgagccacgaatccaggagctggctgccaaggaacgttctgaaccaggcttctgctgccatgtgaaggactttgtggttggaaggcatgggtatggcagcataaagtttgatggagaaactgatgtgagaaggcttgaccttgattcgatcatccagttcaacaaccgtgaggttattgtgtacaaggacgagagcaagaagcctcacataggacagggtctcaacaagcctgccgaggtgacactacttaacatcatgtgcatcaataagaagacagggctgcaatacaccgaaggccccaaagttgagaagtacgaggagatgctgatgaagaaggcccaagagcagggggctgagtttgtgtcatacgatgcagtcaaaggggagtggaaattcaaggtcaggcacttcagctcctatggcattcgagatggcatccgtgatatctagatttcagggaatgcctgttgttgtctctgcatctaggctttaagtctgtccccttttaatgaagggttggaagggtaaagtgtgattgtctcctgaggagaaactggaagcggtgctttgtttttgaggtccagcgtttatagactgtcgtaacttgtggcaatttttcttttttcagaaaaaaaaaaaattcactcttgtcttggtccaagggtttcaagggggagaagttctctttaatgaaaaactgtattttggtctcgatgacagagttctcgatttgtttttttatatggacgtaatttgacttttgtaagaacagagtattcttaaagaagctgaactcaaagccaagttgacatgtttgtttgcaaaattaatccttaacattcgattcgatttgggtcaagctggaagctggaactcgagtcaaggctgctcggaggtctggttccatttatttttgatgccccctgtaaaaaacatttcgctataaagacattgtctggagatttgatcgattaaattagtctgacttatcagcgcaaaattatgtagaataaatagcacataatgaattaagagtaggtcataaatatgtttatacattaggaaaattctgaaatcataaaattagttctagttttatgagaaccggacaaaaactttatttatgagctaggttggcatgcttgggaatatttggctcctaaatgctttctattgaaaaacggtcaatgacctttcaaaataaaaatcaatatcgttaagacatttgaattgcccagaaataaaaaatgatgtattttttgaaggccttttgcctatacgttaaatgaaaaatggccaaaataaataaaaaataaaaacatttcaataggatatatgtatgtatgtatgtacacacacacatacatacatacatatacatatacaaacatacatacatacatatatttcagttgcatctatgatttagaaacatcccaaacaagctaaaatttgatttctatatcctgtaaaatatttaaatcaagattaacattttggtattgtggcctgtttaatttttgtttacgagctatatagctaccactcatctatatcagtttgatgcataagtaatagagacctccatttttttaaaaaaatattctacgttgcaagtgttttaaatttcatagaccataaccaatggtgctgacttttatcatgagaggtcttacattacttttaaggtgtttagagagaaattcccttagaattgatctagtctaattatatataatgtatatatacgtcagatgtatatgagatataactggataggaaaattggttcacctgtctttaaaatagttgagagtctatccaaactcaagattcaagctattgaatataatctgtattttaaaaaacatatagtaatcaaactcaagatctctaacctaatcattaaatagatgtcaaatggatgattttgatagcatgatactgtgttttactatatcgcaatcatcaaaatcatggtaacattaaatctacccacattataagatcagtagatcatgatccattaagtgaattttaatttatgaaccctatcatgaatttgactatagtagtataattgatattgctcattttagtagtaattaattatatgatttctcatcactttttacggtatagattatctccaatagtttagattttgaatttgaatgaactatcattgatttgcaagatagatggactgattttctaatccacccaatgtatatacatacatatatacgtacatatgtacgtacatgcacacacacatatacatatacacacatacatacatatatatatatatacataattaatatatatatatatatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatacatacatacatatatatatatatatatttatatatttatcgagacacacacacatgtgtgtgtgtttgtctctgaccttttaaaggttattatactttctttgatgctccaaaaatgattcatttaagccattatcatttcttttttattatttatcaaacaaaagtgcacagatgcatatttttttataatatgttaagaagaggttgcttatagggtcaaaatgtggcagagagagataattgggcagaaaaattgttacactaggattgttggagaagaattttcaatcaaaataagagaggaagcggctttattttgaggaaaaaaaataaaaaacatgcgaaagaaaggagctttgatttaagagagaacagaacattgaacgatattatcaaatgaccatcgagagattgtgcatttcaactttgggaggttagctatttatttatttatttttcaccacaaagtcatatttcatgaatctaatgtaaacctagttcaattgttcattggattttgctaattttaaactatacagaagtttcaagctatttagatcagacaagggcgatttccaaatttattcttaggttgcttgataaaataggaaaaaaaataaaagaattttaaaatgactcaactttagtattgaggctcagatgaagagcattgtcaagtctcgaatgatatataaggtacatagtttgtaatatattataatatagtaccgcaaatttggattgatagattatctaagagttgaatgccttgagtaggagaaatctagatccgaagaagagaaatttttagtggacactgccaatttagtgtctagtcatatatgttgatagaaagacccgatgtatcttgatgttctatcatcttatctggattttttgattctagtttctagtgatatcataagatggtttagtttgcagttggatgtgaggctctctagactaggaggtgttgctcatgtagcaaagtaattttggataaccatgcatctagaatattctaagctaagaggaagtgggaagaatgtttcaagtagatagagcaagagtcagaagctggttctaacatttcagaagcaaaacatcatctcatggaatttctgctccaataatggtttgttctagctagtagccttctttgtttttttttttacttttatagatcattatttttattttttttactgcattctttatataatgccatagtgcaaatactattgaagttgcttctcaataatagaagataaggatgaaagtggatcaaacaatatccatatgaatttgttttcatatctaaatttattagaatataaatagaaatttgagcatctaattaatatccatatatgtatctacatccgttagaaaaaatgaatatagaaacagatagacactatctgatctatatctgaatatttaattttatttaaaaacttatttagctttatataatactcataattttttaagaaaaataaataatcatattaacatgctattaacttgatttatgatccacttaataagatctttgattttttggtcataaaatttaattatttattttagatctatgtttatatctacactttagtgcccaatttgtatccatatccatctaaaataaatatggatataatttttttttgcatctgactaatatccgcgaacctatattgatactcattgaataaaataaatatgaatatagatatattagtatccaatccatagccaatccattttcaaccctaatagaagaagatatatgcatctattactaagatgagtaacaaaaatgttgtcaaaatagaaacacttgtaatgcaagtcctatagtctttcattcattttgctcttctatttcttgcaataagcaacatatgatgttaagtttgctttagcaagaattgtagtagaagaggatatagctaaaaaataacatggaagttctttagcattttaattaagagataatcgcccatctttttacttatttctttggatgctctgtaacacaggaaagcaataagagcaaaaggaacttcaaattttttgagtttcatcattttttaaatcaattttctttgttctctctcgaactagagctcctttctctcttattttttctttttcttttgtttcttgttctcttattttgatagaaatttctctaataatttactgatatagtaatttttcctcccaagcatctatctctattgcatcttagctctgtaagtagccttttgttgtcatatcataaaaaacataatatttgtgtagttttgtttgattagcaatagaaaaagtgacattaacgacttaaatgaactatttttgtaacgctatgaacaacattataacttttaaaaaactagggacttaaataacttttagcccaaaccttagggactaatttagtaattaagccatatatatgtacatgtatatatgtatacatacatatttttcatttgaaagccatagccccgcatcaatgatttgggccattgaaaatgatctactatctctagataactttcaaactaaaaactatgtgagttggcgatctctaattcatgcatttaggggtcaaaaaataaataaattttttgatgataggtcaaaaaatatatatattattttgcatcatttatacgtactatccattttttaaactaggtagagatatctaatatacggtctcttctttataaaggtgtgcttttgcataattttagttaattttcccccggagcttttctttgggtttctatgttctcttttttgtgagaaagaatgttgatatagttttgtaactagttgaacttgtttttattgtggatggacaaggttgacttctaaaaaatatttttcttttctcttcattctattaacttgctttggttttttaccgccaccccatccctcgatagctaacttcgatctccaagtggcaagagttgatatcatccgagcaagcatctacttatttgtttgtgaatgaacaaaaaatgcttagaatttcgggccaaaaaaaaagggaacaggaaaaaaattgctcaggctgttaaggaccaacttttatgggaaatattgatgtgctaacaattgaaactccaagaatttcttcattgattggctttgttggcaactaagtgcaaagctagggagggctgactgggcttaagaccataaataaagatatttactcattaactctcaaatcatcaaatcaattgtacctttctcatcgattttttttttcccccaaaaaaatcttattgcagccagtcggttgactaagaaaactcaaaagtttagcaaccttggcagaggaggctgcccaacctccaaagaggtatttggcagttgctagtctggaactcttaggacgatgtatttcctactcttaactctcagagaaaccagtgaatatggatgaaagtatgtaaaccgagaaaaaaaaaggaaaaagaagcaagtatgcgatttttcttgtatggttcaaggtcttggcttataacgctagatgcgtagctccttaggccttagaaatagcaaactcaggacaagttaataagccactctcaagcctcaagataaaaatgctagcaggaatggaactaatgttcggaaaacagtccaagtggatgtatccgacgtgctcgtctgtttgtaagacaaggactccagcagtagtttaaacaaaaaaatactccacaccacgagagcagctggttcctccttgttttctcacatggccttcaataattgtggagtcgatcggttctcaattatcttgaagccacaacattatcacaactatgcatctcttatatccaagtatatttatatttaaacatgcggaatacgaatctatttttttcatattccttgatgctcgttactgactcttccagaaaacatgagctggtcaatcgtaagtctttttttttgctggctcatcccatgtgttatcaaaaaaaaaaaaaaagggggtggtccggtttcaatatattatgtacgattcttttcagtagttgaccagcttcatttctaactggatttgttccaatgatgaaatgctaccagctccaagattatcaccatggtattttctatatatctttaattagtgctcttctaattaggtaaaagatttcaggagcatctatatatcgaactgtcatacaccattctgtaaggaattaaacactcatcttaaccatgatgccctatatatgttcatccttcatcttttattttcttttgattgtttgttcatctgtccattaggagcaccgccaatcaattcaaataaatgatgcaagaattatccgcatcggacactggaaaaacagctccggttgtctgaaaataggtcagctatttggtttatggaagttttttatggattagatgtgccaaatatattactcatgcaatattataatctacttttcacacctttcaagagagtaatgttttgtagattttctttgctcgttcaacatggatatccattacttactgatcattatccatatggtattcacaacttggtttttcatacagctatctcagcgataaaattttgcagagaagctagatcgggtcaaaaacagatgaagatgagctgaccgatggccagaattagtgcgacttctgcacaatatgatcgtttaaatgggcataattttcaatccaccccctggaagaatcatgcattacaatctagaatggacagtgttggggtaggttccgtcgcttaaccgactatctctggaccgattaaaaaaattgtaccgattaaccgacaatcaatccagctcggatatataaaattccccccaagttaggtcatgtcactcaagcaccatgctctgagcggctagctgcgcggcatgatggagtactacgatctcattaaatgcgctctcaaggatatttattaccccccacacttgtcagccgtacgacaggacatgatcgatatgatcgcctgtcctctcatcattcattttgatctctctataaatagaagtaagcggagacccctccaagtatgcatagatgcactatctcaaactcagaaactctgccattctttcttcttggaccatttactgatttaggcatccaagaatcttcatcggaatcatctccaatggaatttattttgcagattcttcttttttggcgttaagcgaaacccagcactcttttcttctaaactctattatcgcttttcatcttgatcttgactggtgcaccttcttcgaagatgatatttcattcatcgacaatcccatcatcactggtcggcttttgatcggctatcgactatccaccggggtaaggccgcaacaggcatagaagatccgaatggtttcgtacctattgatattgttttggctactgtaatctttctgacataaacaaaatgttttagcttggggttgcaacttgcatggagggcagtggtaaagcccctcgccagtctcaaaaataaattaataacggcactgtatatttgatatcccgaaataaagtagacatgcgtttatttatttatttgacttttgaaggaaaaaggaggctcgaaaagccacccatttattaaaagaagtagacgagtatttgttgtgtcaaacgaaaggaacaaatgaacaaaggatttctaaggggaggccatttccagagcaaatatttgagcttgggttgctgattgcactccagcatgtgttaatagtataaggatgatacatagagattggagcaggtaaaagccatgaaacccatcaacgatcacgctaatgcctttaaagaatggtgcacctattcgactcgtcaatccagacgatgttgccatgactgcccccaggcttgcatgtgttacaacatggaggcaaaggtttgcactccttcttgtcatccccatccttcttgccatccttcttgccatccccatccttcttgccatccttcttgccatccccatccttcttgccatccttcttgtcatctttcttctcctccttcttgtgtggcccgacactctcaatctccaccatcttcccggccttccgcagctgttttacaatgatcacagcatccaccgcaccaataatcgtcacggtattcttctcgacgtccacagatattgaaatgatccctgtcatgccagcaacacaatttaatcacacaaaaaaaattaattgattaatttgcatatataattcgatgaagcagatagtatatacgttataacatggcatcattgatcactcaccatcgacttttgcgactatcttcatgatgcaggccttgcacttgcagcacaagatgatgatcttcagcacaatcttctgcacctgcgcgtgtcggacgccatggaaaaaagtttcagactgacttgccagatacactaaattattataagcatagtgcacgatggtacgaatcaaactacttcaccatgaaggtttttcaacacactctctttcagaaaattaatattctttatgttatacttattgtctctcaatggacgtatcagcaagctctccgcatatatatatcaaaatgaaacctgacgacactgacgtatatatgtctatgaatgaaagtgatgaatatattctctcatcgaacttggatcagcaactgaattacgtaacgtaacccacaccaagcgttactaatgtataacgtacgtagtaactatagacattatgatggaaaagtactgtgataatcctagtcaagacgaacctgcatactggcatgcacgtgcaaagtgcgattgtttgtggtggctccggccaaagagcttgttaccaaagaaacaagaagaagaagagcaaattaattaagagctatgggagctcccgatggagtcgttcgagtctgtatatataggagcaccgtgggagggctgtgctcggcccaagtccttgcagtcatctcaaacaccttttattaaaatggccatcaatcgtgaattattaggtcaattaggtcggtagccagtttatctatggatttggtggcgaacgcgggtgcagaagcacatgcaatgcgtcgcttagcagtcctcacaagattaaagattaatggctaagggatagaataatgagtggtagccaacccctatatatggatcctttagttttttaattcaagcgaggtggggtttgagtttgacctgcgagattctaatgcatgtgattgcagctctatttgtttagcagagcgaccgcagtctcggagggaggaaactaccgggccatgaggttcttggccgggttggcgagcttttactttagaatttaatttaaaactagggttctcatgaccttggctttgtcgcgagctccagccgacgaggcgcgattggtccttgccagctgtgaggtggccgctgaataatgatgataataattttgccggaccagagtgtatgggtgtccctagtattttgaatccgctagcggacaaaattgtggaagaagcttctctcgtctctacgagaaataattgatgctaaacccgtgcttctttgttccttttttttttttaaatccttagtcgacctctttcaatcgagatgtatatgtgtgcagctatatcaatgatatggatatttgattaatgatataacacttcagtttaaatttcccattatccatcttggaatccggaggagcagatgatgtcggagacagtatgcgtgtgtacctgtccttcttgagtttaaaatcaatattaaggcattcaaactaaaattccactccatccgacttgcttgtttaaccttaaaaatatgtaaaaaccacaactatatcttttagacttctaacttaaaaatcaatgattctaaaatgatatgaaaccatattttgctatatttgaaatattaaaattcaacttatatatattgaaacatatgcatatcttgagcaataaaatagattctcaattttcatattcttttatgtattttagcatgttagtataatagaaagcatccatttttatatccgcatgatgtatagattagagatcaccaaaatatataatacttgatttggaagaaccttagtgatgtagatcatgatcggttgtgtagatattctacttaaatgctttgttattgactttggactcaagaggagtgaagacctcttctttaggagaagtatagttctcttagaattttatagggtgctcatgtatgtagtttcaaaactcttttgaaaacatagcggaataatagattaaaatctttcaatctagaacatgcaaatattaaagcacctaagaatctagtttatatacagaaaataacatatgctgattttaatctaaaaataaaatatgtgatcggatcacatatctgtttcattttttctttcctcaaatctggatctgtaagataaacagattctctcttagccacacaaatatccgacctctacaggtatccatacagaaacaacttggattgctcttcttttcttctttacatgcaattgatcaatccttgatctgcttttggatcgatccttttgatcaactccttgaccagtctttttttcttccttggattttttttgatgtagaacaaccaccaaccaaaactagaaagaaagatgggatgcccaacaccttttgggcaagtggatgctattagaatgcagggtggtttcatgcatatagtttaaaaattttgcaagctattttatacaacgaaagtaaattaaattaaaattttttaatttaataatgcaccagatctcatatgtaaactacatgctagatcttgacacgaacatgtgactttgatctgaaatttaaaaaaaaataaaagatatcaaaaaaaaatggagatctaatctccataccttcagatcctgtggatgtctaggattcgaatcgtacccgtgcaaacacccgacctctgtaagtattcacacggagatatctgatcgaagcaccgagatcaccggtatactagcaccttgcagacttcgctccttagctttggatctgaatcctcttctagagcttgaaaaagataaaggctgtgcgaactcttttgcatagatctaactggatttgatcagatcaccaagaagagaagaagaacctttcttcttctctttctctctctctttttctctcctttacatctgatctcattagatctttgggcatggaggttgaaggaagaagggagggtggtgtttgaaaaataagttacaatgcccaaaaagaagctgttgttgtccagctatgcaacccaagaggagggaagggtgaattagatttttaaaattttaaagttaatttagaactataaggattaaataacaatgagcaggttatatgcagaaagtgatttaagcaaggtgcagaaatgagaagcaagaatgcaagaaaataaagaaacttagaaaaagaacaagtaagcacaacacagacaatcaagatttatagaagttcggtgccaaccttgcacctacatccactccccaagctcttacttgaaaaattaaatccactaaaatgtattcaacaagaatacaacgtcggtaccttcgactctagctatcctaagctagaacatttatttttcagatacaagccaacccaaatacaattcgattcaaggttcggaccaaccttttcaaattttggaacccttccaaaactaaggatcaagacaaaaatagagtataagagttaatcacatggaaatacaagtttaattcctttaatgagcaaattaaaattttaaatacactttacacaacaaggaagaagcttttctgatttttctcaaggttgttgaagacttgaatgagctcttgaggggttggtgaacttgaaatgaaagtttcttttgcttgaagaggcctttttctttagagctgaaatgaatgcttgaaatctcttgcttttttcctcctttaagtgcctttatatcttcaatggatcgtggagagtaatttgaacaggattagagccattgaagtgcattaaatgaacattaaatatagtcaaaataaactaaaaaattagccgttacggagattttctatcgtaggggtcgactcatagggtcgacctctgtggtgcagaacagaaagtcactgttctgtatctttggcttgcacagtaatagaggtcgactcatagaatcgtctcttttgggtgtgccggccaaaaatagtatgccgttcagcccttttgacagggatcgaccctaggagtcgatccttttctttaaacttgattttctcttaaaatacacatccaaaaaatatgaaattatctctaatagatcacaaatcttctgttcttgctcttgaggctttcgaatcagaacttgataaaattacgattttgtctctgaaatataataaatctttttccaagccaaaataattattaaccccttcaaatattttataatcatcaaaattaattcaaggagcaacaatctctctctttttgatgatgaaaaaatatttgagcaaaaacaaaatataacatataacatatataaagcatagattaagaattttaaatttatgaagatacgttacttaaacattatagccaattatttgaatagaaagtatcatgagtagtttgaagattagttttaagatagtttatgttgggtataaaataccccccagccgaagttcgtgacaggagtgaccctccggggattctaccgacttccgaccttcggctacatctcttcgaacctctctggcggccgagcctctgcaatactcccaagttttgccgatggataagcccccaccagcgtcgatcggattcttcacgatggacggactccacccaagttttcacgatgatcgaccgccttctagacttcgtccggatccctacgggagccggacttcatccccgactccggctgcaggaagacttcgtccggactcctacgggagcgggacttcatcctcgatttcaattgcaggtagacttcgtccggactcctacgggagccgaacttcgtccccgactacaattgcaggtagacttcgtccggacccctacgggagccggacttcgtctccgactccggctgcaggaagacttcaccctgactcctacgggagccggacttcgccctcgacttcaattgcaggaagacttcgtccggactcctacgggagccggacttcatccccgactataattgcaggtagacttcgtccggacccctacgggagccggacttcaccttcgacttcaattgcaggtggatttcgtccggacccctatgggagccagattccgtccccgactacaattgcaggtagacttcgtccggactcctacgggagccggactccgtccccgactataattgcaggtagacttcgttcggactcctacgggagccggactccgtctccgactacaattgcaggtagacttcatccggactcctacgggagccagacttcgcctccgacttcaactgaaggaagacttcatccggacttcgcccccgacttcaactgaaggaagacttcatttggactcctacgggagctggacttcgcccccgacttcaactgaagaaagacttcgttcggactcctacgggagccggactttgccctcgacttcaattgcaggtagacttcgtccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttcacgccaaattcaaattagtaggaggcgtggcccctctaattcatccatatattggtgcgcacaaattgatcacatcaactggcataatcatggctagatccaaagcatgtaggcacccagcaattgagtctcttgactccaatttcaaattcaatttggattagatctaatgcatgtaactaatttggtctaattcttatccttaatccatgtccaaagaggaattggatttaaccatatgttagtaagacttttctaaacccaatagaattttactaaatcccaatccaattgggacttcataagtccaattggtcaatccaaattagtttccttgtttgtgtgactttataggtttaattctgtctggtagtgagatatactatgatctctatcataatatcattgaaactcttttcaatagatcgtaaccattctactctcactcaataagcatcgccgatccaaaataatccaagtgagctctcacaatctatcagtgacatctagcagtatgtagtggcaagccagcagaatcgaataaagaacctttaggtgtagttctcatgtgatttagttcctttatcgtgagtcccgacttgatagcaggtcatgaataaatcatcaagtctcaacatcagtcatatgatagattcgattaacttaagtctaataataattcatataaaaattttttttcatcaatcacactgctatggccacagacttaaagacttaacctcttaaatccaatagaactacttctttctattaaaattgatagattccatctagaaatgcatcctgctcctatagtggactaattgtcgccaacatacactataaggattcaagtgactaagagatcatgtttctatgcaatcaaactctaacagcctcactgtgagcagtcgtggcactgcagatcaaaagatcattcacacaactacagcatcaagatgattactgaagattgtttagaaatctacatgatctcttgtatggttatgctcagtactagttgttctcttacaattatccatactttttgcttagtatctctatactgtagactagagatccatctatctcgaagaaagtgatctgtatgtcggtctatctagatcgatcaccatcaccatgatgatgttatgtctcaaaatcaatcattagacgattgtgctcatattgtaaagtatatataaatttttattaataaaaattatttggtatttttattataaattatccatttttgaactcctgtgttgtaataaaattcttaggactataattaatcgataaagaaagatttatcgttaagtccctaaaatatttatgattaaatgatatgttattaataggatgatagcattatcaagtatcgatcgttacgtgccatatgagttggttgttctcttaaccaaggagtgtggagatactattatggcatgcaaatagaatgtagaagtatattcgcatcgaatgtgattatgtgtcgagcattctgctgtcaagagtagctcgtaaaaggtatgaatataagtatccctccgacttgagaccaccacagtgacttgtaagcaacttactgtactttagtaccggaccatctgagtttctaactcagtgacggaaggctattgggtgcagtcaaatacttatcaagtcggtgtgcgagtcaagatggaattaacccctctgaattagtaagagatatgcatcagtgtatttcaatttagtaaaatcttgatcagaataatccataagatggatttgaaaggttgagatacaatatggttgactaaattaggattgacagttaaatcctaagtcatcttgagtatttggattaaagaaatgaattatatgatgaccatacaccaataggttctagaaggttgctttgcaatacttcgacctattcgatcatcggatcatcattgctagatggttatattgattagtataaaaagttattcttatgctatcaacttaggttcaaatctatgaggtcatacatattagaagatttggttagatctgatggctgaatagtctaattagattatgactctggtgaacagtcctactcagactaggactctgagggagagtcccattgggattgagattctactatttatgaagaattaattaataattagattattaattgactcaatttgattgaacaaaaaattttagatcaaatctaattgaattagattcagttcgactctgattgggtttgatatgatcgaatccgattataagaaaaatttgattctgattcgatcagaattttgactctattaatttttaattggattaaaaatttgatgagatatttaaatttataattagattagattcattcctattagtaggttcaatctaaatttaatttagattagaattgaattagaaatgaagagtccaagtcaaactaggactctatccttatctcctgcaccactatcgaacccttaccaatttcttcatgcctaattggatttggattatgatttttggcatcatgatagagggtctaataagagtgggtggcaatagctgatgagccataatattatctcttgtctaattcgaatgcgatccaaattagagataagaggtaaactaggaaaaaaaaattttgtatataaaatattattgatgtcatattaatttttttttatttttcttagagaatcttttggtatgtgagattttagaatccttctccatatcttaatggtttttttggaattttttgggatgccaaaaggaggttttggcattgactcttggtgcctttccttggaaaatcctaattcctagtctgtaaaaagaggtcctctctcttggacgtcccatgatcaatcccttgctgatttttattttcagagcctcttctcttctttctctattcttcttcttgatcctctcttgctttgaagtatccaagatacttgaagaagaaggaacaaatcagctatcgaagttgcttgtaggctagcacctccaagtctctgatctgtgcctgtctttgcatggatttttctgtagaggtcagatgactctgtgtggctgcaagcaccttaggaacaccttctccaactattggatcagagaaaatcaagatctaatttgtttggtaacgatctctaatttgttttgattcctatggtagatctaatagttggatctagaatttcagcatcgatgagatcgatgtaatttttattttcaaatctaaagtatatatttttatatcaaatattatgatgtggtagtctaagatagaattttatgcatgtgattaagattaaatcgtttaatcttttttttcgttgcataaaatttttaaattgtatgtactgcactatcgcatatttctttcaactggtattagagcatgattattttgatataaattaatataattttagatctatttttttatttaatctgattatttataatttagattagatcaaaattaatttatttttagatctgattatcatctgtttagattagacgttatgagtagcaaagtactcggattggataatcatcagaccgttcggtcatagaagtaagtaagattttatgaccctctcctcccattcaatggggtactcttatggcatataggggtgccactgtaaggtctcacgaagatgaaagcgaaaagagaaaacttactttcttccaaaatcctagatcttgaaaccttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttctctagtacaatagttgtagatggtcaagtccatatctttgattaaactatatggatcttgattatggctcagtgattgaattcaaatcattaggttggttaaatcgaaactaattaaccaattggagtctaagataagtttggcatttccatcggtagtttttaattgagagtggcttacctgatcattttgatggtatctaaggcaagcttagcagatcctcccatcaatctcacttatctggtcaatttggtgaactagattttgattagatcgctaagtgatttgagttagcccatgccattaaggttgatcagtgtgactgatctaggtgccagttcaatcagcatgacctaatccgattcaatgacttggtggagtcagtaggagggttgtggtctgctgattgatcttttcttctctcttcttctctaaactgattaaattctctaaattattaggtctctaaaatgagctagttatggtgataactagatcatagctttctattaaggtgaatggtaatgggtcaattatttatgattgacattgtaggcgccatccgtctgatgtttattctgaatgatggaattagtatttatcatatgatgactctgttaaactatctgatgatcattgggttgatcgagccatcctcggatctaatcactcattggttagaatcactgagtaggttcatgttagtggtttgacttaaccgaaacttttagtggatgcccatcgcctactgaaataaaatctggagctaaattaaatattaaatattatttagagaaataattgattgagaacctatccatatgtgatatgggttgatcgagccattctcgtacctatatataatctgtgtggattctagtatccgctaagaaattaagataattttttgaattaaaggtagaggctaccaattcgtataaaatagtggaagaatctttagactaaaatccatatctttaggatcaataaatttatatactaattaggttttgtgttttctttatgtgtgctaatatggactcaaacttatcgctccgatcactgttggacagtgagaagtttactggactgaatttcgataattgatatcgaaagttaaagatagtcctagagcatgagaggattctttatgtgataacggatccgacatcgaggtgcagtctgggatacttatttgaagtggctcaacgactgcattatggttcgttgcatcatgcgggcttccatgaatgacgagttcaatcgaaagtttgaagaggctcagtcagagaaaatgctttaagtgttgagggattcctttggtactcctaacaatgttgagcggcacaagactagttgtgctgttttcaatattcggatgagggagggtgcatctattaccgatcatgtattgtacatgatcgagcagattgaaaaactaagcaaactcggcttctccttgcatgaacaactggagaaggatgcgatcctgaactccctatccaagtcctacctactgttcttcagtcatttcagaatgacgaagtccgtagtcaactactatggtctgttgggattacaacagacttttgagaaggatcaccagctccacaaggagatggtaaatttagtggaaggatcttctttgggtaatcatcgtccctttaaaaaaaaaaagaagaagaataagaaggtgtctggtgctgggagttagtctcagaaatcaaagttcaaggctgatcaaagttagacaaagtgcttcttttgcaagaagcaggatcactggaagagaaattattctcagtatattactttttctgatccgagcaagccaaagacgaagcagcaatcggttgctggacaaggtacttatgtgataacatcttttaacttctctctttttgatataatgacctaggtattggataccggtagtcctatttacatttgcaattggttgcagggtcttcagatcattaagagctttggagctggcgagagattcttgaatattgaagatggaagatcagtttcggttcgagcctcaggaatcatcaagcttgtattcacgtctcattacgttgttcttgatgagtgtcattactatcctaattttcttttaaatattatttctgtaggcctcttggtcaattccaattatgaaatatcaataaagaaaaatttttgtaatatcattttgaatgatgttacaattttgtgtggatagttgaataatgatatttatattgtatctaggcctaatgtaatgtacatttcaaataaacaccctagaacagatgatgtcacagatgcctacctttggcattgtaagctaggtcatatcaacaagaacaggatgaacatgttagcttaagaaaagattcttaataaagatgattatgaatcattatctatctgtgtgtcttgtttgcttaaaaagatgaccaagtcacctttcctgaaaatggtgaatgaaacagtaatgtgctgggtctgatacatactgatgtatatggacccatgagtacatatgtcagaggaggatatagctatttcattatattcatagatgacctatctaggtgtgggtacgtctacttgatgaaatacaagtccgaattatttaaaatgttcaaacggttccataatgaagtagaaaaataaactgaaaaaaatattaaaactctttgatctgtatgaggagatgaatacctctccaatgaatttttgacatatctaggagagaatgagattctctcccaatggactcctccagagataccacagcataatggtatctcgaaaaggagaaatcaaatcttgttagacatggttcgatccatgatgggatttgcaactctatctatcttcttttagagatatgtacttgaaacagcctgtcttgtgctcaataatgtatcgagcaagtcagttagtaagacatcatatgagatatgatcaggacgtaggccaaacctctcttactttagggtctggggttgtccgacttatgttaaacaattacaaactgacaagctcagtcctagatccgataagtataattttgtaggatatcccaaggaaatgagaagatattacttttacttgtctgctgaacaaaaggtgtttgttagcagtaaggtatactttttgaaaaaaaaaatttaatgaagaaataagtgcctctaaaatcaaacttgatgaagtttgacaggtagaagaacggacatcaatgattgaatctgaaccgaatttgataagatcaaacccatagcccaatgaacaaatatccttaaggcgatctggtagagtactgcgtcagccggataaatatttaggtttcttgattcgggatggagattctgttgaactcgatgagaacaatgaggatccgatcacctacatggatgcgatgtagaggtctgactctgacaaatagcttgaaatcatgaaatctgaaatagagtctatgaaggtcaatgatgtatggacattctttgactcatctgaaggggttaaacccatagggtgtaagtggattttgaacaggaagaggggtgcagacggaaaggtagaaatctataaagcccatttagttgtcaaagattatcgtcagtattatggtattgactatgacgagatattttctcctatgacaatgctcaaatccattcggattatgcttgtgatagcagcatacctggactatgaaatctagtagatggatgtgaagactgcttttctaaatggagagctgaacgaagaggtgtatatgatacaacctgaagggttcacatccacagatgagtccaaggtgtgcaagctttagagatccatttatagattgaagcaagcatctcgaaattagaatatatattttgataaggtgattagaatgtatggcctcgttaggaacggagaggaaccctgcatatataagtggacaaatagtttaataattatatttcttgcattgtatgtggatgatattctgttaatcaaaaataacatccctgcattacagaaaataaaagtgtgactatcatcatagttctccatgaaggatctgggggaagcagcctacattctaggaatgaagatctataaggatagatctaagaggctgtctgaactctctcaatccatatacatagataccatgctgaaatggttcagcatgtagaattttaagaaagactatcttctaataggccaagaaatttctctttcgaaaggagattgtctgacaactcctctagagagagagaatatgagtagagttccatatgctttgatagtgggttctattatgtatgtcataatatatacgagactagacatggcatactcactagggatagtgaatagataccgatttgatccaggagaaaatcactggaagatcgtaaagatcattcttaaggatttgagaaatactaaggaccagtgacatgtatagtaaaactgacttgaaactgatgggattcaccgactccagctttcagtcagaccataacgatagtaaaaatgtatcgaattatatttttatcctaaatggtggagtaatatgctaaaaaaattttaagcagcacactgtggcaaactctgtttacgaacagtatatcgcggcatccgatgctgtgaaggaagctgtatgattgtgaaaattcatcgataagctcagagtgacaccctccattgatggccctgtcttgttatgctgcgataatactggagccattgctcaagccaaggagtcgagatgacatcagtgcaccaaacatattctgcaccactatcaccttatccgaaagatcgtggatcgagatgatgtcgaccttaaaaagatcgacagaaagaagaacctgaccaatttatttactaaagctcttgaaatcaaggagtttgatgaccacaaatcgaagataggtattcgatactgtaccgattggctttagtccaagtgagagttgttgaaaaatatgtcccaaaatcaatcgttagacgattgtgctcatcttgtaaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaccatatgccagtaggttttagaagtttgctttgtaatacttcgatctattcagtcgttgggtcatcattgctagatggttatatcgattggtatagaaagttatttctatactgccgacttaggtttgaacctgtgggatcatacgtattagaagatttgattagatctaatagctgaagagtccaattagattgtgactttggtaaatagtcttactcggactagaactctggaggagagtttcactgggactgagactctactatttttaaagaattaattagtaatcagattaataattgattcaatttgattgagcaaagagctttgaatcaagtctaattgaattagattcagtttgactctgattgggtttgatatgatcgaatccgattataagaaagatttgatcataattcgatcagggttttgactcagctaatttctaattgggttagaaatttgatgagatatttgagtttctaattggattaaatttatttctattagtgggtttaatttaaatttaattttaattagaattgaattaaaaatgaagagtccaagtcaaactagaactctatccttatctccaatggcactcctgaacccatgccaatttttccatgcctaattggatttgggtcatgatttttggcatcatgatagagggtccaataagagggggcggcaatagctgatgagtcataatattatcttttgcctaattcgaatgcgatccaaattagagataagaggtaaactaggaaagaaatttttcgtatatagaatattattggtgtcatattaatttttatcttatttttcttagagaattctttagtgtatgagactccaaaatccttctccatatcttaataatttttttgaaattttttgagatgccaagaggagattttggcattgactcttggtgtcctttcttggaaaaccctaattcctagtcgataaaaagggatcctctctcttggatgtcccatgatcaatcccttgttattttttattttcagagcctcttctcctcttcctctattcctcctcttgatcctctcttgctttggagtgtccaaggtatttgaagaaggataaacaaatcagctgtcgaagttgcttgcaggctagcacttccaagtctctgatctgcacctgttttcgcatagatcttcctatagaggccagacgactctgtatgactgcaagcaccttaggaacaccttctccaactattataccagaggagatcaagatcaaatttatttgataacgatctttaacttgttttgattcctatgatagatctaatagttagatctagaatttcagcatcgatgagatcgatgcaatttttatttttagatctaaagtatatatttttatatcaaaaatcatgatatggtagtctaagatagaatcttatgcatgtgattaagattaaatcatttaatcttttatttttgctgcataaaatttttaaattgcatgtactgcactatcgcatattttctttaataaggactcaagtggctaagaggtcatgtttctacgcaatcaaactctaatagcctcattatgagcaatcgtggtaccacagatcaaaagatctttcacacaactacaacatcaaggtgattactgatgattgattaaaaattcacgtgatctcttgtatggtcacgctcagtactagttgttctcttacaactatccatacttgccgctcagtatctctatactatggattagagactcatctatctcgaaaaaagtgatccatgtgtcggtctatccggattgatcaccatccccatgatgatgctatgactgaaagtaatttaagaattaattatacatgctcttaatttttaattctttgagaatatgtatcgtaattattaatttcctgaatgattcaagaacatatcatacttgaataaaaataaaaattatctttttattgatcaaatcaatattttaaatataaattttgtgccttagaaaaatacaatgtgtctgtcatattggcttctagaacatatatctaacaatcttccacttgaattaaagtaacttagccactaatctaaatttcatcttctcaaagtggacttccatcttaggtgggctcaactactttgtcagtgggtctgtcatattattcgtagagtctactcttcgcatctcgatatattttttctcgagatagtcacgtatgatgtgaaactaccgctcgatatgcttagattttttataagatctgatctctgtagcaagtgctatagctccgttgttgtcgcagtatagtggcatggcatccaatgtcattacaccaagcttcatgatgaattttttgaaccagaagccttcctttatcgcattcgaagcaacagcatattcagctttcatggtcaaatctgctatgatgtgttgtttggaactctttcagctaactacaccatcattgcatacgaacacatatcctgatgtagattttttatcgtcaggatcagatatgaagtctggatcgatatatccctcgatctgcaactcagaccctcctcccaagatcaagaacttttgctccaagaattgattttgatgatcacaattcatttgaggggactactaatgagtttcttatctttagagaatattttagtgatatttcaggtagtttaaaaaattgagtttgaaaagctccatcaagtgtactaaagttgatatttctgtaagttggagaaatttttaaagccttttgaaagtatcaaacatatttaaatttatttaagagcatttgacaatgttctaataagttttggatcttaaatatatgaaaaattgggttagaacaaaataagatgacccaactaggtcatccccttccattgagtagccggtacgttctatttttggcttgtagcacgtagtgggatgacctatgggatgacctctgagatcctgagaccaaaatagagagtctatttttcagactggccaaatgaggcgacccatgggatttctcaatcacagtgggacgacccatgggatgtcccattctgggtgaacctcgtaatgattagttttcagtttatttttggtacatttaatgcgcattaaatacactccaacggctcttaactgatactaaaatactcttaagtccaaatagaggctataaatactctctagaggtggaacatcaatcaagattcatgcattgaagctcacattcgtgaaagtgaaagaaattcctaaaaagagaggaaagaagtaatcaatcagctcaccaaccactctccagctgtattcaagtgtgccaatcatttgagggtgtttagcaaaagcttcttctccttaagtattatatttttattgcatttattatgctcatttaagggactgttgtgctgaaatttttgtacactatccatttgctattgtattttggattttgagttttgggagttttcaaaacttggataggttgatccgaatctgaaatcagagtgtatgtgggttggcttatacccaaaaaataagtattcttgcttggatagcaagggtcgatgttattcgatgttttgtatcttgtaatccttttagtggattgaattctcaagtaggaatttggagagtggatgtcggtgcaaggttggcatcgaactactataaatctcttatgtttgttatgcttgtatatcttctttcattcattgtgctttatacgtgtttacttatcatttatagttgatcttattttcttagctaatcaattcaccccactcaataagtatagcacattacttaagagaactaatcataaaaattttaaaatgaccgaattcacccccccctcttgtgctccatatctgggcaacaagtggtatcagagtccaatgctctagtccttgcttgatttaaccatcaagagtcaaagatctatgacagtctaatttagtacatctctagctgagagacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtaacattggtatcactctctccacttgtattgaaaatatgttacttgtagatggtctcaagcataatcttttaagcattagtcaattatgtgataaaagttacaaaatagtttttgaatcatctatgtgcattgtaactagtctttttgatgatagcactagattaattgggcataggcatggcaatgtttacatggttgatttgaataattttttcatgcaaaacatgcaatattttatagccatgaatgctaaaatcaatgagactagttgactttggcaccataggcttgcacatattagtacgcacacactatctaaaattattaaaaaagatttaatttttgatttgtcaaagataaattttgataaagacaaaatttgtgatgcatgttaattaggtaaataaacaagagtttcttttaaatctaaaaatattgtttcaatttctaaacttttagaatttttatatatagatttatttgatcctacaaggacaactagtctaggaggtaaaagatatgattttgtaattattgataacttttcgcatttcacttgggtcttgtttttagcatctaaagataaagcattttcagtattttttaagttttgccaattatttcaattcgtaatgaccatggcactgaatttgaaaataaagattttgaaaaattttgtgatgaaaaagatatagatcataatttttcagcacctagaatatcacaacaaaatggagtagtagagagaaaaaataagatcgttgaagaaatggtccgtatcatgctatgttagagcaagctcccaaaatatttttggacagaagtaatcaacacagtatgttatattttaaaccatactttaataagatcaattttaaagaaaacaccatatgaattatggaaaggtaaaaaatctaacataggatattttcatatttttggttgtcgttgctttattttaaataatgacaaagatagcttagataaatttaatgtcaaatctgatgaagctatccttcttgactattctacttctagcaaagcttttagaatttttaataaaagaatactagttgtggaagagtcaattcatataatttttgatgaagctaatgatcttccatcaaagaagagagaggatgctgatgatgtaggtattatagaagaaggaatgaaagagctcaccatcaatgactcaaatgagcgaaataaagaacagttgaaagaaaaatatgaggatgagagcatcaatgatcaaatcatttaagaacaacctcaagatacaagtaatcttccaaaggaatgaaggtatttccataatcatctcaaaaaactaatcattggtgatctggcacaagggataagaattcgatcctctcttaaagatgtatgtaattatgtagcttttatttcacacctagaacctaaaacaatagatgaagctgaacaggactataactagataattgctatgcaagaagagttaaatcagtttgaaaaaaataatgtatggactcttgttactagaactaaaaatcatccaataatcagaataaaatgagtatatagaaataaattagatgaagatggtaatataatcaaaaataaagcaagattagttgttaaaagatataatcaataggaagaaattgattttgatgaaatatttgcacctgttgctagactagaagccataagaatattgcttgcttatgcatatttcatgaattttaaattatttcaaatgaatgttaaaaatatttttctaaatgattatattgctgaagaagtatatgtagagcaaccctcagactttaaaaatcaaaaatatccagatcatgtatttaagttaaataaaatattgtatggtttaaaacaagcctctagggcttggtgtgaaagattaagtaagtttttactagaaaataatttttcaggaggaaaagtagatgcaactctttttataaaaaaaaagatgaaaaaattttagttatacaaatatatattgatgatattatatttggatctactaatgaagtcttgtgccgagaatttgcccagctcatgcagggagagttcgagatgagcatgatgggagaacttatttttttttcggactccagatcaagcaaatgaaggaagagatctccatcatccaaagtaagtatacaagagaactattaaaaaaatttagaatggagagctccaaaagtgtaagtactcctatgatccctttctgcaaattagataaagatgaatatggcaagaatgttgattcaaagctttatagaggcataatagtctctttgttatatcttactatcagtagacctgatataatgttcagtgcatgtatatgtgctagatttcagtcaaatcctaaagaatctcacttaaatgctgttaaaaaatttttcaaatacttaaaggaacataaaatctaagattttgattttctaagcaatcttttgttgatttaatagattattcagatgcagattttactggatgtaggttagatagaaaaagtactaatgaaacttgttaatttttaagagttaacttaattttttggtttagcaaaaagtaaaattcgatggcattgtctacgatcgaggctgagtacattgcaatcgaaagttgctgtgctcaaattttatggattaagcaatagctcatagattttagaattgaactaaaaaatattcctataagatgtgataacactagtgccattaatttgatcaaaaattcaatccaacactctaggacaaaatatattgaaattagacatcactttataagagaatatattcaaaataataatatagtacttgaatacataaatactgaaaagtaattagctgatattttcatcaaaatattaagtgaaaatagattttatgaaattagaagagaattggacatcttagatccttccatttgatctctcattataattttactctcaaaatctatccaaaatcttttaacttcatcatcttaattttgagagatatctatctttttttaagattattttaagtcaatttaaagatcatcaatattattcagatatgatctcagattttttttctattgaaattcttcatcaaaaattataccaaaatttatctgaactctacatgatcatctcaagtcgatgcaagtcttttcaaattttttcttttgatttttttctcattttgaattattcttttattgcctgatttttctgtagatgggacgacccatacggcgtcccaattgttcgggcaaatggattttgtgtgagccgatccgtttaaattccttgcttaaaacccaaatgggccgactcatttactattcttcttcctcctctcctcatcccaaaccaaaaccctactccaagctccccgccgaccacattctcttaaatccaaaccttaatccgcctaaaaatctcttgtttctaccttaaaatctagggtaaacacatcctctcgacatatctttgatcaaaaccctctccttcttgctctctattaaaactttaagccctaatctccaaaatctgagacaatcacctcaaaatcccttctcttcatttccatccatccttcaccctcctctattctcttgactggttctcttgctctcattgggacaatagcccccaagatgcggttgccatagagaaagaagttagtgaggtctttggaggcagaagaaagaaggaagaagactgctcaagtttcagttcaagcctctcctcccataatttcaagtaagatccctctgtctgcaagaaaggttgccttgggaagaaatattgattttcgattcttgagaagtgatagatttacaattgatgcaaaattaatcaaacaaaggtggagatttttttgtagtctgtctgagcctgtatacattgacctgattaaggagttttattcaaatctagtattcattgatagggttctaagattagttgtaaagggtattgaaattatctaaatgctgctaggttgggtaggttacttcaaatgccctgtgaaggaagttgcctcgataagcttccaaagaaagagatcaggctcaggatcattttaggaagagaggatgtggagcggttcataaaaattgaggttaaagatttcagtgtggagatgagattgctccaccacatgatttctagaattttcttctccagagggggtagaaatgatttgatggctgatcgagatatctgtttgatgcactatagtctctgaatctccactaatttgtcattcttgatgattgatgccataagggaggtcttgaatagatccaaggctcccttgctctatggtatggctcttacagtgatatttagggagtctggagtgagctttgagggagaggttgtttgcagattaatgaacactgacacctacaatgaccactcccttcgacgcatgggatttatcagagtgaatgttcgttggaccaaggggcgaggagctgcagtcgaggaggaggaggaggagcgtgctcagggggagggtccctcatcaccacctaagcccaggtagagctctgatgttcattttgtataggagcctgaggcaggaccctcagttagtgcatctccgtctacgagccatgccgtgccgtgccatcatcacttagattgggagaggatgagatgggattgttagctgagcgagtagtaggtattctctccatccaacagtagcagttccagaagtaggtccttcaacggcttcagtattatcagcagcagatcctccagcaggtgcagcagcagcagtatcatccacctcagtcgagttcttttctgtctcttcctcagatctttcagtcgtgccacatattttctcactgatacagcttttgtttgacctgagctccagactggagagtgtagagagctccatactcaggtttagtggcaggatctttgatattgagagggagatcagactgatactagattcactgtcagcaggagcaagcacttcgagcagctcttcaccttagttagctgatctagcttgagagattgagagactccatagcctgcttcgatcgacacttgagctaatctagattgatatcaaagactcgagggactttattttttctgatcttgaggggctcagaattttagtgagaggagtcctgtcccaactagatgccattaggactcagctcgagtctaaaccctccgtatccagtgagcctacttttgttcagcctatcgcctttcgtcctccgacatcttctactcgaaccagaccatccagtcgaagtcgaggctgattttatttcaattattttgatcttgagcttgatgcccatgctccttgatctgatcattttgtattaccagttttaggttacatactacttagttgttatattttattttagtagttgaatgtatgagagccttatgctcatagatatatattatgacttgatcattgtaatgaatgaatgtacatgactcttgtaacctcttattttattataattaatgtatgagattatctattatcattactttatatggccaacctctgtttatatgtgaatgaaggaatgtctattacatttaaaattactttgatacctgatgtaccatcatagctcattaaaaatcttactctctctagtctatttttgatgatatcaaaaagaaggagaaggtagcccatcttgaatttttatgaatttttttgaattttgctctgatacgttcattttttactctgatacgtctatctttacttctattttaatatttttataaaatactctgatacatctattttttattcttgttctgatactttcatctttgccttaatatcaaaatactctgatatatctatttttgattttataaaatattctgatatatctatttttgattcttgctctgatactttcatctttgctttgataccaaaataaggaagagagaaagaaagatcctatatctatttttgattcttgctctgatactttcatctttgctttgataccaaaataaggaagagagaaagaaagattctacatctatttttgattcttgctctgatacttttatctttgctttgataccaaaataagaaagagaaaaaggaagattctttttatatacatattgctctgatactaaaaataaggaagaaattttttttttatgaactatttttgctctaataacaaatataagaaaaatttttacaacttgaccactttttatataagaaagagagagaattttttttaaatagttaaaatggttactttcattttttttatataagaaaagagagaattttactgattagaaataatttttgaaaaattctaatactttcgcaaataatttttagtaaaatgatttaaaatattataacttactaaaaatatgtatctcatgatattctatacttaatctttggtatgtttctataagtgcttcacaaactcaatctcttgaactttatggatcttttttatgaacacttaaatattttatcattatcaaaaaggaaaagattattgcttcaagaattaattttgatgatcacaaatcatttgaggtgactattaatgagtttattatctttaaaaaatattttaatgatatttcagatagtccaaagtattaagtttgaagagctccatcaagtatgtcaaagttgatgtttctgtaagttggagatgtttttgaaatcttttgaaagtgtcaaacatatttaaatttatttaagagtatttggcagtgtttcagtaagttttagatcttaaatatatgaaaaatcagattagaataaaatgggacgatccaactggatcatctccttccattggatagccggcacactctgtttttagcttgtggcacgcagtgggatgacccctgagatcaaaatagagagtctgtttttcagactggccaaatgagatgatccatgaaacttctcagtcgtagtgggatgacccatgggatgtcccattctgggcgaacctcgtaacaactagtttttagtccatttttgatgtatttaatgcgcattaaacacacttcaatgactcttaactgatactaagacactcttaagtccaaatgaaggctataaatactctctagaggtaaaaaatcaatcaagattcatgcattcaagcttacattcatgaaaatgaaagaaatccctaaaaagagaagaaagaagcaatcaatcagctcaccaatcactctccagctgcattcaaatgtgccaatcatttgaggatgttcagtaaaagcttcttctcctttagcattatatttttattgcatttattatgctcatttaagggactgttgtgctaaaatttctgtacactattcacttgctattgtattttggattttgagtttcgaaggattccaaaactcagataggttgatttgaatatgaaatcggagtgtatgcgggttggcttgtatctgaaaaataaatattcttgattggatagcaagggtcggtgttattcaacattttgtatcttgtaattcttttagtggattgaattctcaagtagagacttgaagagtggatgtaggtgtaaggatggcatcgaaccactataaattttttgtatttattgtgcttgcatatcttctttcattcattgtgctctatacttgtttacttgtcatttgtggttgatcttactttcttagctaatcaattcaccccactcaacaagtatagcacattacttgagagcactaatcacaaaaattttaaaaagacccaattcacccccctcttgggctccatatctgggtaacaagaataaatcttgagttcttctcaagtacttaagattgttcttcatagctatctagtgctcttcatctggattcgactgatacttgctcgcgatactcatagtaagggcaatatcaagtcgagtatacagcatagcatatatgaggctctctatcattgagacataagaaatcctactcatacattgaattttttcagatatagtcagacatatcttcttgaaaagatgaataccaagcctaagaggtagaagtcctcttttagagtttttcatgtcgaacctcttcaatactttctctatgtacagctttcgtgacaagcctagtattttcttaaatctatccctatagacttttatttcaataatataggatgcttcttctagatctttcataaaaaattttttggacaaccatcttttgatcgaggtcagtatgaaaatataattttcaataagaaagatatcatccacgtacagtatgaaaaatgttactgtactcccaccgatccttttgtatacataggattcctcctcatttttgatgaaaccaaatgatttgatcgcatcatcaaaatgaaggttctaactccaaaaaatttgctttaatccgtatatgaatctttgcagcttgcagactctatgatctctatcatcgaaagtaaaatctaaaagttgcttcatatatatatcttccttaagatatccatttaagaaagtaatttttatatccatctatcagatttcataattataatgtgctacaacaacaagcaaaggacgaatagatttcagcatggctacagataaaaagatatactaataatcaatactttcatattgactataattttttaccacaagcctagctttatagatctctaccttactatctgtacctatttttttttatagatccatttacacccaatggatactatactctttggtggatccactaaggtccatacttagttcgagtgcatcgagataatttttgacttcattgcatctaatcgtttctcaaaatcgatgtccgatattgcctcgtcaaaggtattttggatcatctccatgacccttatctcccataaggaatatttttttaacatcctctgtaaacatacctatatacctttcaggaagataggagatcctactagatctatgaggtggtagagaaaaattaactactagttcattaattatggatttttaaggatctatagctcattgctgtttagagatcttctcttcgagctcaattaacctccgattgctactatcctggataaactatttttttaaaaatatagtataatgactcacaatcatattgttatcatatggaaagtaaaagtagtatcctatggattcattcggatacctcataaagtgagctatggcagatctatcctctaatttatcagtcatctgtcttttcatataggctggatatccataaattttcagacgacctagactcggcttcttaccatgtcatattttatatggtgtggtaggaacaaatttagtaagaatcttatttaataaatatattatagttaataaagtatatctccaaagatataaggataaatcatagcttttgctggcaaatagctaaagccaaaaaaaaaactttgaagcagtgccaaacagggcatggtaagttggtagagaaagtttttgtgcaagcgcatcacccaataatattgagatacatagcgtactttgatggaatagatatttaataccgctcaatttttttttcttaatttttagcaatgaaaatattttttttgatataataaataaagaacaatattattactttctcatatcttgtatgacttctagtgaatatatatatatgatatcctaaattatagatatgactttatatatctttataatattctgaataatatatataactttctaataacttgtatgactttttgtgaatatatatgatatcccaaacaatatatataacttctttatgaatatatatatgacgtcctaaataatatatactgtttcctaatgccttatatgactacttgcatatatatacgacatccagaataatatatatgacttcctgtaaatatatatgatattttgaataatatatatggcttcctaatatcttatatgactttctatgaatatatatgacattcagaataatatatacgacgttctgaaccatatatataactttctatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatataaaattatatattcatatatatttataaaaaattatataaaatatcaaaaaataataatattattttttttattttataaaaaaaatgatattatctcatttaaatgtgctgcgtgcccttttattaagcggttgcaccgcatgcggtgacataacgggctttcgctacttcgataagaggcagttgtttttcccagcaccagcattttcccgcttgtgcttcggatattcgccgccaaaccctaaacccaaaaaaccctaagcctctttttcgcacaaagatggggcgcaagaggaaatttatcgacaagaagaactccgccatctttcagcttcttgcccgcgattcctcctcctatcccgccacctccgccgccgacgatggcggcgcaccggcgtccgaccgcgtcttcgtgcgggtcgacaacaatccctactccgtccacggcctcctcgacgaggaggattgcagcgatggcgacggcaaggaggtcctccccgaggtcgatgatgccaattccatcttcgccgatgcgccaggcgacaccgatgacgatgggagcgccccgccgccatggattggcgccgtcggcggcgcatcccggggtcgcaacgggaacgcccttccagaccacgtgaggcgggagattttggagctggggctccccgacgatggttataattacctcatccatctccgtgagatcaagaatgccggcggtgggtcctcctactaccataacagcaaggccaggttcgattgggttccgctcgatgttaaggtatttgttcttccagtttgattggttgattgattgactgcctggaactggcaacttggttccttttcctgatatttttttccccatcaatttaataggcctacgacgcttcaaggcttcgaattagctctgcggtcggtgatgagtcgaatggggattcaatctatactgttgcttcgaagactgttggtgttaaggttcagaaggcagtggatcctgatgtggcgaagttgctggatgatgatgatctgtcacagtttggatcggatgttgaggatttggaggaggatttcgtggtcaaggcaaatcttcctgaaggagaggacgaaataaatgaggaggaggaggaggaggaggagggaggtggtgagaaggttgctgccaaagaagaggttggcatggcaagagatagccggtgggcagagcaggagaatgaatttgctcagggaaatggagaagatgaacttaagggtggtgaaaagccaagagttcgtcgacttctggatgagcaatttgatcttgtgagtttctgtgttttattcactattcccttttatatcatactggcttgtcctgtgatccacatatttttagaaaaaatgcaaagaattaaacagtatgctgtaatgatgtgtggaagtttttagatacatcgtagaacatataccatacccatgaataacaattcttgctttagctatttgtcagcatttaagtgcttagctattcatctgatagttatgtgaacaaacacatgcacacaaactgaccaacaactgaacatgactgcatcttctgtcaggcatattgataaccaatgtgtgttatagcattattaaggtctttagggctagcagagtctaacaattcgtgccttaaagacaatattcttttttcattgaacatcttcatcgatttagagcatacttgttatcatggaggaaagttatatgtaacttgccagtttcttctagttaacacgtaggaaggacccattgaatagtgaagtcattcaaattagagatatgcctccataaaagctatacaggttaacttgtattagattacttagctcattgtcggaacatacctgtcattattggaggaaaattgtatctaacttaccaatttcttatagtgggctaaacatgatttcaatgatcatgtagtcgctgttaactttgacttttatgatgtggctctgcacttttctgttgttaacatttgtattatttgtattttgtatggagaaacctcgtaaaacttcagaatttttagcccatcaatttgtcaatttggacatgaagtttgaacaaaagttcttgtaagtcatcccaagtctcttatttttagaaagcattaaggtacaggcatgtttgttattgtaaggcttatagttgcttgtatcccactagcttagaaggtcatgcttccttttgaaaaactaaaagcaaatatagtttgagaataattaaaccaaataaagtgagagacccttacaatcactggagatggatcaatggagttgttcatctctaaggttgaactagattatgtatttttatcctagcaaaacaattgcttgcctcaattatgcctcttcaaaaagtaagcctatgacaaaacaaaacatggatggagctctcctctagctcctttaattacaatgttatggaggtgatatttgtatatttttggagcttagactgtaaattgaatgaatgagttagaaagctattctaacattacttaaacactctctcaatgtttctacacactaaatgttttaactgttacactcttttactcttggggtcatgtttgactggaacaagtggagtcatgataatgccggcattaaatagaaagcggctatgacttctggatttattataaccaccacccaacacattcaagaataaattcataacttgatctgccatttatgtgacaaacgacctgtcactttgtccttttaatcccagtgacacaaatgttatttcaaattatcaataattgtacatattggcaagcaatcatactatacgcacatgtgcaacacataacccattttggcttttaggtcagaagtcaggtggcacttttagccaatttaattcgaacttactgatatttctgctagggcaaccctcgggtttatcctggatggattttatttcaggtttggttcgataaaaccccattgagacactgaattctggtgatcactatgacctcttgtattgtgggattatcaaactatgacatcaaataatgagcataatccattaaacagacgaacaggtgaaagatgtagatgtagagacatatagaaacaaaaaaaaaaatattgaccacataacattaagctgtaggattaagtaacatataatgaagtaaaccaaaaaatttgagaacatgatgttccattattaaacaaatattgctatatataggagtttgcattgattttggcgagcccaagaatcgaaccagaccaatcttgttgggctggtttggttcacattttagataagtttgggtcattgcagttttgattcttcaaaataaagcaattagattaggcacggtctgggttaagaggttaggtaacccgacctgacttgacccaatccatacacacacatatacacttgggttggagtttgtgatattagagatcttcattcattatcattagcttataactttatatcttctgtgtcttgttagtttgtagttgttgatctttttgttagttttactaaacatcttcaatgatagcttcttttttatattcattgagtctcgaggaattatattattcctaaataaactcaataatttatgtttttaagaaagggataacccgagaagtgtccgaactgaccagatcttgatttggttgggctatgacatttattgattcagttctggttccaaaagacgagaattgattgagatcagattgattctaggttggcctctaaccctaaccaccctgaccaatgtgcacccctggttattagtcctgatggttatagttaattagttattgttatgatttagtgcccttaactcgcttgtaagtttttattggtagtagttaactgttaatgtctacatatatagttgcttgcttgcatatgcaacatgcttcaagaactattaataggcattttctggtttttaacatcttctattttactgaatgtggtgatggtaactatgggtggtgagttgttatggttgagatcttccattattgcatgttgtggtatctaataatctgacatttagcatatataaaattgaaattggtgatggttgttggcataatctgacatgaatatatgtatcatcatcctggtgaatgaaacaagtactaaataatgtgaaatcaacattggtgtagtattagtagttccatatttcaccaacatattgtcatggaatttcaagattgaggcatgtttgctatattttagcactttgctgtttcgagggtctattctttaatttacaagattgcagatgttgcatttcattaagtaaattccctataaacctgtgatctctcccatatcttacagtcacgtatattttctcttttgttacagctcacactgcgagaatacgataatgacagtgaagatgatgatgctgtttatgtagatactgaacgtgaattgcttgctagtaagattaaaaatgtccttaaagagtatgcaatggatgatttggaacttgatgacaagtatagggtgccaggggtttatgtacatggtcatcaagtgccaagcacagagacacagctggatgcatctgctgatattatccgcaggtgtgcacagtttgctgaacagtactgtaatgagagccaagatgatgaagagattgtggttgaggaaagtagtgaagaatctgaagtatgggactgtgagactattgtttctacatattccaatctggacaatcaccctggaaaaatacaggctcctgagaatcctaaaaagcgtattccaaaaaattttcctggagacttagttgccaagagcaatgtgattgcacttcgaggaaaagaaaagcttccggtggagtacttaccacaaaagaaaaaaacaggtgaaaatttaaaaacaacagtaaaatcagatgctgacaagccaaagaggagacaacgtggggaatcaaaggaggacaagaaagagcgcaaggtaactccaatcaagtagttttcatgtgcttgttgacaatttgtttgcaaaaagaaatagaattgaatggaaatggtcattttttcaaatatcttgttttcctcagcgctggtgagcacctctctccttagtccttgcactggggctgggttctgagtttgacttggaataaaggcattcccaccatattctgaaaaaaaaaattgtcttgtttcatgagatatcaaattttaattttaggttttattttcagaaactattcttgctattaatatttcatggcacataagttattaatttctagaacttaatgactttctatatggtaattaattgttcatggagcaagataattaaggatatttggaattggataattagcttcaacgttgatgccatgaactaagctataaaagtcatgtattgttcattttgggtttgatttttctagaactttgctgatatttatcatcgttgcgagagaattgaaggcttcaattgttcagaacattttctcagcatgaatttatcttgtttaactgcatgtctgcaactgcttagctgttctcataataagacgtacatctgcattttttatcccttctaatattatctctttaaggaaacctaatatttgggacaacacttggtagttatgatggttatggaatttcttttttaggtgtgcttttatgctagataattatgatttattgtgccttagaatgtcaggattgttgtaatattgttgtacatagaacttgtggagcttatgtaaattctgtggctgtaataagcaggctgccgtaaaagaagagaaaagagaagcacgaagagcaaagaaagaactgaaaggcctgtacagatgtgaaacccagagagctcagcaggttgctgctgtttcagggccatcttccatgcaccttatgtaagccaatccgcatttgttgcttctgctaacaataccacctctaaattaaatgaaaatattccatcatttccccacttattttgtccaagccaaatgacaatttacttctcaattctttgtaaatccttctaagatagtcctgtcttctgttcccaatatatgttggcacttaaagtttttttttaaataaatatcatagattgattaaattttgtagtagtttctcattcacttgcattttaaaattctctcctctacaatttgatcttgctcagtggctaccttagtttttcttttcttttctttcatctttcttttcttctttcagttgttggtcttgacatctcaccacatttagtagaaaaaatttatgctgggggctagaaattgttaacatgactagatttgctattctagttgaaattgtaagagtttgttgaagtgtctttgcatgctttctagcttctgatatatatgtatattatgtatgtatttgatggttcttttggcataggaagcatgtgagaagtgtatatcctgccacttttttctgcatgttgattgaaattctcattacttgtcaaaatacgtgttgacattttttagttcttataaatgccagattattttacaaattttaatataataaagaaaatttaaaatctaatatcttttttaacaaaggtagtaaggtgaatcatatactttgcttcaccagtagcccaaggacttagttaatgcattgccacatgacatgtcaaatctaaaatttttatttcatggacttggttaattagtatagcaataagctagttgcttgactatttccttggagatgtcaccaggtagtaacaacactccaggcattagaataccattgattgttgctcaatgattttcattgttgaccagatacaagtacccctgtggtcgattgagcttaggcatattattgagcttcgttagttacagccaatggctgattttaggatactagctaagatatcaggcagcacattattatgctggctattacatatttggtccaaaacagaataaatggagagcaacattagcttgaatatggttggattcaggggattgactagaattaagggatgaggagttctttcaacaagttcatatttataaaatggagtttgatgcctcatgcaggtctaagttaatgtagactagctattgacttgtttgtatggtgcatgtaaacacaaattgtgattgaaattaaagaagaacagtttaggaaaatattcttaagactttggaggatgtcagaaaagccaattagacaaacttggtgaaatgtcttaggtggctgtaccggcaatccttgaatttcattttgaaaagagatatgataatagagtattcattcttttgaactttgaagctatatttccattgttatagaagtgctcaacaaagtcatatcaagcatttgaactgcaaaccaagatacaatcatgataatcctcccaaggagttaaaacaccatctatcaatcttagagtgtcagcttgcaggcaaaactcatcctttcatggatgtaaaaatgttaatataaccagtctaagggatgaaattaaatagtaatttttgcttaatgaatcaaagagtaccattcatccctaagtcatatctagattacaaaacataaaactatataccaaccaacccatgttcttctaactgttaaatcaagctcattttcccttcactatcacatagacctagaataggctgtgaagaagagaaccagtagctaaatgaggatttgggaggaaaaaaatataatatgaagtaaatatactaaaatagtgtaatttatagacaataaaatatttatcatgcaaaaaactgaagatgaataatgccctcttctgctatatacaacttttgtcaattgtaaatgaaaattattgtggataaatgaactatctttatagcaataaatgatgactatctatttcgttcccaaattccaattaaaatgctagcaaaattctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctctctctctctctctctctctctctctctcgtatattgaacaccagcctcacctagcagtaaggtggtgtggctagcggggaagatacatgcggtagaatctgatggtgcagtggtctatgctagaaatcagctattaacaaacaatactgaaggtaaagagggacatttttgcaaatcttgaggtagaagaaaaaggggaagtttgattttggcacttaggctcagtgttcagctcttgaggggttatggttgacagttaggtctttgatggaaattgacaatcagggtattgattgcgaatgagaagtgataaaataaggaatcagggattagttgagaatgagaagtgagatagaagacaaggggactgatgcatcaggttggagaatgagaacttggattcataaaacttgtcaggtatctgggttcaaacctggacatgcatctcaaatctggtttggatttatatctggggaactttaagacttgtcaaaatgcagtcatccataaatttgtacatctgaatggcacctaattcgaatatagaaacatattcggtcagaatttatccaacccagtttctactctgaaaagcaattatgatgcatgtattccaccagttatttaaagcaactaaattgcgcttatatttgcaaatgatttagagtgaaaaggcattaggggtgaatgtaatgccagttgaggcaaagaatattgtgagtgtagttggtcataacttattaaacaaggaaaagtgctaatcaaggtaaaatacaagcttgcagcaaccattttggtatttaatttaaatgccacaattagaagttgtgtaaatggttggaagaatgctttaagaaagctaacgacaatcctctacgatattttacttgatgtcaatcaaggaaggtggaatcgtcctgaactatccggtttggagtgtatcaagccatattggcggtggatcgagatagttccagcaatgaaattgagaaactggcaagggagggggagagggagaaggaaaaagaggaaggggggagggaagggagggagggatggagggagagagagggcagcgcgataagcagcagttgaagccctctctcctccatgcatcgaaatagggcagagcctctaattcaaaaagaaatgtgggcttcaaccccttctttaatttttttttggattttttgtgtacataccctcctaaattgtaatttgtatgaatacccttgcaaaactgatatttgcatgtataaaatacttattttgcacatagacccttttttttttcttttttcttttttccttaatgggtaggaatgcaaaaaaaaaaatttataagggtatacatgcaaatagtagctttgcgagggtattcaacaattttacatatttaggaggatttatatgcaaaaaaaaataattttatttttatctatttcaacttgtttaaatgcctagattatactcatactcacttctatttcaacattgctcatgaaaaaagatagattcaatgattagataacaaagagaggttttgaaatttctttcaccagttatgagtttattctactttattcttttttatttataataatcattctatcttatttcatcgaaaatcagcttgtaatatttattattatatatgcatataagagggtatatattagtatatataatgggattaaaatctcttagaggcacatgatagattgcaatgatcaagcttctttgtgctcatggatgaaagaacaacatcaatcacccttgaacaaaatcattgaaggacttcagaatttttagactcactaacaacttccgtggctatgtaataggaggtcatggcttatgttggatattaccttaagtcaatcttctttggagcttcaattttttgaaactaatgataggttcacttttcaattcagcaatcaaagccaattcattataaagataagaggattgctagtatagatatttgagtcaaacaaaaaaaaatctagacctttcttgactagctaataaggaagattgtggctaggatgaagactcttagtagatcttttggtctgagcctaatcataggccatcattcatcattcactaggtcgtccaatttttctagctcaaagctcgtccgatctctccaacttggagctcgtcaaatctctctaactcggattttggctgcaagaagccctatattttgaggcacctttgattttttttataaattttataatggctcataaataacatctataattacgcatttgcaacaaggataaataaattcacgatcaatttgttcaaacaagtaaggtgcttgtttgagtttgaccaaagcttagcttagctctggcatggtcaagcaagctatgaaacgagcgaaaatctcttgagcctagtttctatttttttataccttaagctagctaacatgtgaaatcttgacatatgcaagaatgaacttagagaataaagcttgaatcgggcctatgaataaatttatttattttagggagaaagagagggtataaatctcttttcttgagcagtgttttcaccgaaaatattaaggagtgagtatgagaataatctaggtatttaaacaagttgagatagataaaaataaaataatttttttttgtatgtaaatgctcctaaatatgtgaaattgcatgaatacctttgcaaagctgctatttgcatatacacccttatatatatatatgtgtgtgtgtctttatatatatatattgtgtgtgtgtgtgtgtgtgtgtgtatacatgtgtgtgtgtatatatatgtgtgtatgtgtgtattgcatgcctactcattaagggttcagtcatttaaattagaaaccatttcttaacagctttagatggtgggggtatatatgcaggagaaaaggaaaaagaaaggtatacatgcaaaataagtgttttataaaggtatacatgcaaatattagttttcagagggtattcacgcaaattacagtatttaggaaggtaggtatgcaaaaaatcattttttgattttttgacgtcaattaatattgattgttggtagttgagactatttccttgctaacataattggaagattcaatgtgcaccaaaatgattgcaacccttttgggaagcaaacaaagtatacattgatagatactatggtgcatatatactgagacatatgtacataaattgcatataaagcagcattgatgagtatcattagctatggcaaaacaatggagttctctatcgacatggtcttacttcactaactcatacttcttgttcatttgtcatatagatgaaatctctcatatcataggtgcattgctataaattggctagatgatagtgatgatgattgcatatgctgtattggaattattgatgtctggaattcgatgttttagtcattgtttgtaatgcatttctttaaatagaaaaaagcagtctaaattaattaaacagcaagttgatatcctatgttgatttttattattttctgcaaaggcagaaaagaatggtgagccaaaaacaaattcaaattcaatagtgcagaaattggtagatgcttttgggccgtaaattaatatgatcaatgcatgcccctgagaattgggcaagttctttttacatgtttcctaaaaccaaagccgggttgtctcagtttcagtgataaccaataaagattggacctggcttccaaattttgtccagcgctaacttatggagccaaatttgttacaaatatgtgctattttttgcttttctttcatacatttcaaatgtgggtaagcatttcaacttgtttaaactttgatcctggaagtttggagagttttgggagcatcgcaacattatattataaagaggtttagaaagtattaatcttttaagttaggtttctctaacctaaagttcaaatttcttaggcattttactttatcatttgtaagattgctatggtacaacaaaatgatatatcaaactgtgaacatgatttttttgttttacattacatttttaaaaatcatattttaattctatcattgtgacaaaagaaatgatatttacgaaggtctatgctatgaaatgatgcctaacttggtttttctcattcattagtttttctttagattttttgatttatcctagtgtgaatcaacaatttaacacatctttttttaataattttcatttgaaaatggagccaagagcaccaacacagtcaaaactgaaactcattatgtatggagtttttcatagtaaattctttgcaaggtttaccataccggtcggcactataccgaatatactgtaccatgctatattgatattgaactaatatgcagtcttatattgtaccgacattcgatacggcttgctggatcataccataatgtgtattggatgctgtaatatgatgatactggtataggttccatactaagagggcgaaccttaattctttgtgttgatgcaagagagttgggtctgatcacgtcctcactcctgtatttggctaggcttccacccatcctagtcatcaagaattttaaaagggagctcattatgattgagtcaaaaccaaagctaattctcaaacctcactataaattgatagatgtaacaactaataaatctcacaatgttgtattggacgggagtgcttggtgataaaagagggctatgtacataatcaaaatatggctaagagttttgaatttgttgtaaagatagggaaggttaaggagaggaattagtatgagaattgcactttttgtggataatatggtaaataaccagctttgatgtcacggccatgtgcaatgaagatttgagaacacaccaatggggaaaggctctcttcatcaacgagaattggggaagatgatattttatatagaaattgtgaaagtacttgatgaaattagcaaaggcagtgggtgtagccatgcattcactaaacaaagatgaaggcttatgaatccactataaataggtgatctaatgcttgttcattatacctatcattgcatcaatagctataccacattaatcagaatgtgggtggcagataaaagggataaggatgccaaggaagatactaaaggggtccagaaagattggcaggtataaatggaacagttagtaatttttttaatagaagagatcatttcgtatatttttgaacatctagtcaacttaggccaattgttattttttccatgtgagaagggatattataattcaggttcaggggactaatgaggatgcatgcttatcttgcaagcaaaaaaggttcaatagtctacctttttttttaatttatgccttatgtattctaatttatttatttccatttcactgatttatgatttatgttgggcctaaataaagactttgtcatatgttcttgtgtaatcaaagtttgaatataaatgaattacatagatgttactgattatctcctccttgcatatttatggtgttgatagtattagagtaaccgagcctgccttgactgttagttatggtgccctccatgacaggtaacacccagtttggttggctgtgagttattctttcatgacatgatcaagaaaagacccggaacaagtaaagctgtatggtctatggctacacttgcatgccaaacttaccatgtttgccgaagcaagcagcccaatgcatgatgcagtcaaaaggtttctacatatagctcttgggataaaatcaatcaatcagatatgcaatgtttgttctcttttggacctaaagcacaggttgttgagcttgttgtaatgccgtcagcagcactttctagcatactggggtggttgagttattattattattattttttttttctggtttatgtcatctagtttttatgaacccgataaatggaagctgctgtgtcctagtcttttccccagaacgaagctccaatctctggttcacagcattttgtttggttgctcgtgttcttaatgaaattatggaatgaacaggaatctatcgtaaggtctatcacgactggctggtgtaattaaaatcttcggctcggagacgattggtggtctcttgcaggtctgacttgatgaagaaatatggttgggggtgggggggagtgggcgcgtgggggaggtggtgttgggggtggggtgtggcggggaccggcatttgtttgcattgatagctgcagactgcagttgatagaaaagacacaggatggccggtttccccttctgctttacgatttatttaacacagtggagccccatcccgagaggactgattcgatcaatgcaagtgacaaatataagagcagttcgcggacagtgccatgctatcgaactcttgagatgcagcaggggagtattttagatatcgagtcattattgtggggtagggacgctcttcaatttttaaattatgtatgtcgtgatatatgtttgatgatgtgtcttgatccaacgataaagctgtttcattatgacctagaacatcatggattggaaacgcggatgcagactctccgtgtattgggtgaggtttcatctatcattatatccagcctttcgcaaatcctactatgacggaagctccacgcactgatttagcgtttgacatgtgaaagcagagatactccctttgaataatgaatccttgggatgcatgttcctttcatatagttacgtaactggtgaatggtggcgatattattcaataatgaatgggtttacgggaaaaaatcgtaagaccggacttcaggcgacgagcatgaagtgtcaagtgtgaatcttacggcaaaggaactatcgtatgtaggagctattggttttcgttattgtccaaagaggttgggattagaatgcaaactgcaagctgaaaagtttgcagggcaatgtgcatgcattgtcagggtcagcgggcggaggtagaagggcctccaactggaactaaattatataacgagatccaaccactctatactcatcttcaatatcttaactcatccacttccttaaaccaatgtaaagagcttgtaagacgataagacgcaggattccttctctgtgggaggaagcatgttgacgagttggatagggttgacccataaagctcgcttaggcttctagtggtgaaatcggtatccaaatatctgcttatgacccataaatatccgatgtgatctgtcaccagaacattttattctggaaaaattctccaacgcaagtcatacagattagaaagcacccgaaacccaaaaaataattaaaaaaaataatgaaacagtttttttttttttttttgaactattgacattaggaaaaccataagtaaagagacagaaggtggcccccaggttttgggtggtagtttttggcggatggtgtgaagtttgtgctgcactttacttggcagcagtgctacgctctttgcttttttcgacccgacgccgacacgaacagtgacatcaggactaccctcgcacggtaaaatatctatccacccactctttcctgtctcttaagtaacacctaacaataatatcactaacctaatatgactaaattaacctttcgaaagcacgagtagctaaacgatccaatcaagagagatggctgcggcatattctgattggggaccgtagcaacccaagagccagctagctgcgttgaaacgcctccacagtcatcatctctatctctaatcaaaattccgaggacatggtgcacttgcagccgcgcggttgtacatgtttggaacattagggaggttgcacctaggtcagccaattggccacgcctcgatcagccttaacggaaagattaagaagcattgttcaagaattattgctgtccgggtttatttatgctagagcttaagaagaatagatatcgacctataaacatgaaccgcggatgctaacatggaatttcagatcgagagcagttcgagccatgccctactactatgtagtcgcatgaattattgaagcatgagaaattgagtctggacacatgcaagtgatattggcgtgtgaatgtcaagtgggcttggaacacatgcaatcataggaaaactttttaaacgacagcctaactaccgtaccaaaaaaaactagtattgtcttttccacctagaaacctagtcgatagctactaatcaactaacaaagcaaaatcatttccatagataagaaaactaattaaacaaatctaaagcaatgaatcatccgggtaatcattttctgaacccatatcttctcctcatccgcaacagtccaagtaatttaatcagcttcctgcatgtcttaactcattaaataaacatacttcggtttctcctttctctatccatccattcgtcattctgtcttgcttcacagggctatatccatgcgcagattctcgcgtcacaccttccactcggaatcgaacgcaatccccctataaatacgagtcctctacccccttttccctcaactcctaccgcgctacaaaaagtcaaatcccccttccaagctaataataagcaagagagcaaattaaatgatgtcgaccaagtcctccctcctcgctctcctcgcccttctctttctcgttgcctcctctctcgccgctgatcccgacatgctccaagatctttgcgttgccgatctgaactccagtgattgccccctctctcgatcgacttgacattactcctgttctcttcaactcgttttatttattcatttatttaattggcttaattttaaagatgagaaagcaataattaattaattaagcatgcatgtcttggctattatattgcattgtagtactaataatgagatgcatcgattggtgatatacatctgtttgaccactactgcagctgtgaaggtgaacggatttgcatgcaaagccaacgtgagcgagggcgacttcttcttcaagggactggccaccccgggggccaccaacaatactctgggatccctggtgacgggggccaacgtggagaaaatcccggggctcaacaccctgggcgtctccatggcccgcatcgactacgcccccggcgggctcaaccctccccacacccacccccgcgccaccgagataatcttcgtcctctacggcaccctcgacgtcggcttcatcaccaccgccaacaagctcatcaccaagaacatcaccatgggcgaggtcttcgtcttcccccgggggctcgtacacttccagaagaacaacggccatgtcccagccgccgtcatcgccgccttcaacagccagctcccaggggtccaagccattgccgccaccctcttcactgcctctccgccggtgcccgatgttgtgcttgcccaggctttccagatcagcaccgaggaggtggagaagatcaaggctggcctagctccaaaaaattgatattaaacatatattagacatgagcttatggatacatgagcttatggatttcccatttggtttgtcgtgacaagtttcagacttcaaacttccgaattgttgtgttcctaactcatgatttatcatttctttggtgtcgttctgtaacgttgctttctttggtgttgttctgtaatgttgccttgtttcagagaggatgacggaataataattaaaataataggtctctctctctctctctgtatatgtttgtgtgtctatatattgctttctttggtgttgttctgtaatgttgccttgtttcagagaggatgacggaatctcaaacttctgccaatgctatcatgtctcccattctagaatcataattcgaggatacgaaagctgccatatactcataagagttaacttaatactagcttaaaatctcatgcgatgcacgacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggagagagaggagacaggagagagagagcgggagggggcggagagagggagagcaggaaaacaaacgaaagtgcatcatggactcattgcaatgatttttttcttaggagggctcgctggatagaggagggaggggagaagaaacttagagggaaaaattgtaaatttctccaactcctggggtgaggctcaaggtttcttcgttggtccccttcttactgaatctagcattaggtcttttctttctcctcttccacgtggtgtcgtttttttttagcctcctacctcaatgtccccgaactatggctttcctgtcgtcgttctcgacccatccgtggacctccttccacggctccatgctagtagcttctttcgttcccctatggagatgaagttctctcgctcgatcgtatttcgctgaggagatgggctcatgcactcccacacttttttcaaaacctcagcgctccaatgcggcttcctccgattttcttagatggacacatgacagacggaggcttttcaatatggaagctccattttaatatatatatattagatgtagggtgaaaagcaagctggccagtagggctaggccatgcccctacccaaattgacctggtcaaatattttttaggcttccaacctggcataggcttaaaaatatttggataatctaggcccgtgcctaactcaaactcggttgagctgacccaaattatccatttgggccaaattggattgaagtttaatatttcataaggttgcttcataagtaaattatctagctaataattggactttttcttataacacaaataaatgatatatgatatatcattctcaactaaactcattctaatttgtgctttacttcctcatcattctctccataaaacaacataagaaactgttatggacaagggctcgaccggcccgttatgtgaggtattgtccactctagcccgtagatctcatgattttgctctttaaagggcgtctcacgtgggaaggatgatcccctccttataagcatgagtctcctttcactcacaacctcagtcaaaggggactctgatgcgtactcctacagatagtgtttgtgtactcccatatatggattagtatatggggagaggagccccacagtccatgtaaagtggtgccctcctagtgtcattgttgcgatcaaggactcataacttagtatgtgagatattgtctgctttggcctttagccatcttgggtctttgggcctctatccatcttgggccttatgattttatcccttaaaaggcatcccatatgggaaggatggtcctctccttataaatacgagtctcctttgactcacaatcgatgtgggactattggtgccctctacattattaaaacaacaaacaaagcctttcagtcaagggagactttgatgtgtgcagttcgaggagtcccacagttagctaagacgtacctcaatcccaaagaaccaaggcatacctcggatcctacctggctcgtcattattatggacaagggttcggcctattatgtgaggtattgtttgctttggtaggagactccgcttgtgtataattcagtcaagacagacttcagctttagagaatcgaggcggaccttggctcctacctagcataccattattgtggacaagggcttggcccattacatgagatattgtccgctctggcccgtaggtctcatgattttgctctttaaaagatgcctcttatgggaaggatgatcctctccttataagtgtgagtcccctttgactcataatcgatgttggactattggtgctctcttcacaatagaaacaaatagatataggtttgaatttggactttgctccagttcttactcaagctcgagccaaggccaggtcaatgacatatttgagccttgcccaaaaaataaatggactttgcatttaagcttaaacctaatccgaactttttcgagcctagctcatagtcgaatatgaagttagcctaacccaatgagcctttggccaacccgatccccttttcggtcctacctataaaaatgcaaggcattccatctattagagaatccaacataactcggaattcataaaattcatatatatgtagtaatgattatcaaaacaactaaaatatcatataatcatgctcaccactatatgtcaaaaatatgtgtcttcttccaaaatttatatctcaaaatttttgtatttaagctattttatataatacccaaacaaccctttttttggtagaaccaaacaaccctttaacgtacatgaactgatgaagactagatctactaatcataaaatcaagctggcctctatatattctcccccaaaagttgatattagcttaattcttggttcttggatttagaaagatatagatgaaaattataagcttcacaagtcagtaaataataaatctattttataaaattggattaattaagccatattaagtaatttatcttatttaaattatacaacatatgatacatctgtacaagtagaataggattataatattttctttcaatactaaccgtatgttgaaacaatgtattccatccttttaataatatcaatatataatgaattcatatatcatattagaatcaaataaatattcggtctcataatcatactcacattcaaatacttgaatctcatgtataagtttcaaatctatttagctatatggcctagagtatagctacatacatccttatggtgtaggtcaacgaccatatttaaccactatgataaggattcttatccaaaatagtgatcacaagacccaattaacccctatagcgtaggttatatgatcacatttaacccttatggcgtaggtcacatgactacatgcactcttatggtgtgggtcacatggccacatttaacctatattgcatagatcatataatcatgtcctggtccatatagttaagcacaatcaaatgatacatatatatacatacataaatcatttttttttcttttcagtgctgcttatgagttttatatttgaacatataataatttcaactttacatgcttagtcatattatgataatttaattatgtagttacttatcagaactccaataataaattaaatttcatataattataaaatttcatatgcaactaatcttggaattatgatatcaatttacataattaatttataataattattagaaattgtaaatattactaattttgcggatgtctataacaatagcagaaaatggagaataaaagaaagaagggtagaagaaggtgcgataccctcccacccatttctacatgcaaagaggaaggagggaacgatggggaggagagagagagagaagggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgaggtcccctcattggtgttccgatcgacggcacggtcggcgtgaggcggccatcggcaggaggggagtgacccaacgatgagaagagggccaaaatcgatggtcggcggcgaccatcgacgtcggaaatcaacgaaaaacgagcaaaatatagaggttcttccgcaacaaaatccggcgactccaatcgccggcgagcatgcacactggcatggaaaggaagggggagaagagaggaaggggaggaggcttacctccgacaccggcgaggcttttccggcgagaaattggatagcacaaggacgggtctccatgaggaatttctggcgattgccgccgttgagcttgtgatctttggtggaagggagagaggagggatctcctccttaaatagaaccggagggagctcgtctccgactccgattgggagccggcgagaggaggaagaagactcccttcgggagtcttctcccctatttttctgtttttttttttgttcatttggattcttacatgggttgggccatcacaagtagagttgtgatgacgtggtagttgaggacatttgagacttatctggaaatcctgcaaaatagaacaattagaagcaaaggggaaaactatttcatcaaagacaacgtgtcatgagataaaaattttggaagtagatggatcaaaacacttatatgaatggtgttgagtggagtaaccaacaaagacacatggacggaaccttggttccaatttatttttgctatatggatgtaaccaggaaaaacaaagagaaccaaaaattctaaatttcaagtagttaggactctgattaaatagaatatgcataggactctttgaattcaatacagagccaagcaaacgattaataagataagtggcagtgagaaaaatatgtggccaaatgcttaaagaaacagaagcacgtgataggagagcaagtctagtttctacgatgtatctgtgtctccttttagtagttcctatgatttgaagagtatgtggaggtgaaacaaaatatgaaataccaagcttagcaaagaattgtttgactttaaagtattcacttcccctattagtgtaaatagaaaaattttagtcttgaaataattttcaactaaggcctggaatttaagaaacatagaaaagacttcacttttattttgcaagggatagagccatacatatttgctgaaatgatcaacaaaaataacataaaaatgataatttttagttgaagtaacagaaacaggatccaaacatcagagtacaataaatcaagaggacccctactttgtaacgttgacataccaaatagaagacgatgactcctaaacaactaacaaggctgatataatgacaatgactgacggtcagacactagaagaaaatattcctggacaatttgctgtaaaaccttggaagatggacgcccaagccatgcatgctagtttggaaaggtggttcattctccaactagtgtaagtggttttgaggtagtgacatgaaggtaggagggtagatagtagacacctcctttatttggcccgtgcaatagagtcgccccgtagtttgatccttaatcaaaaaatatgaaggatgaaattcaattagtgtattgtttgacttgcagaattgagaaacttatatgagatttttggcaagagaaggaacacaaagtaaattagccagaataaaagaagattttagagtattaagagcggtggagccaatatgtgtgattttcaaacctgaaccatcacctactatcacctcgtcaggatcatcatattcagagtgaatggctagattattgagatcaattgtaatgtgatgagaggcaccaaaatctagcaaccaatgcttagatgaaccttcagaagtagcataattgaccatgggatgctgcatgagttgaggacagtactttgtaatgtgaccaattaaatcacagtaccggtatttgggtgggggttgactaaagtgattatcaaaattattgttagtgttgttttttctcccatgattgttgttttgattgctgtattgcctacggttctgataattattggagtttccaaaattgtttgagtagcctgagttgttggagtgtccatctctattatttttttccttcctgtaagagttcccgttagaacattggcatgttttctgagtatagtttgcagtagcaacaacaattttagataaggattcctccctcttcaaatgttctccatgtgcaactaatttatcatgcaactcttcaaaggacaatggattatcgcgtgtgaatggaagcggtaatctctttaaaatccgaatgaagtctattaaggacatacagggtgatatcttcaagtgataatgatctgtcaatgattgccagttcgtcagcaatgatttggtggagaaaagataatctgtcatagatttggagccacgagtcatgttttgaaggcactcctcaaggctcataatgcgggagcgtgagtaattggcataaagattagccaaggttgtccaagcttcctataagatctcagctgaggagacaagaggcaccacatatttagagacggatgtgatgattgcatgttgaagtattgatcttggtgaatctatagagtaaacatcaggtttgagaaggttttgtcaccttcagtgatagttttgaaaggtttggcaacacttccatctatataacctagcaaaccatatctaacgagtaagaacatgaactgagcatgccaggaagaatagttgcttgctgtgagtttgagcgtgactgagctgctgcatttatagctatgagctgagatgagtttgactcaagatttggggaggaagaaatcacaacaggtgaagcagagtctgagcttgacactctcttttgaattagaagctctgatgccaagtaaaaacttaacagaagttttatgaaaagagcttcaccctatttcattgataatttctgtcatatatacagagatacatgagctaataagttacaaggaaagtttgaaaaataaattagagataataagatacaagtgagttgttacataaacaagaagttgtcgatacaattaaatttaaattcaaaactatttaattgattctctaacagtagagctgcgatgatgtgggtcagttatgataagattatctttaataatcatcacatcaatccctacttgccaagtaaaggaatggtagtcgttattattacacatatatagcgcaactctccctttgaaaacaatgattgtaagatcttaaatcacattgctatcaaaaaattaaactaggtctaatacaaataaaactagctagctagtacatagttacgaaagcaaaaatgtaggaagaagcttcctaagttattatttttgtaaactattttcagattttaacgaaaaaccttgattgaaaaggcacatgattatatagatataagaggaatatcatgaagctcgaggaagatgtttgggtcaaagataaccaaattattatccatacggaaggatgggagggtcaactgtatcaaactcaaaacacggacaaaggaaataatagaggagtgcctctatttttggacgcttaataggcaaatctatcagatagctaatttcttttagatgcacaatggagggcctatctataggtaatgatgattctcgatctaaagctgctactagtactatgaaaaaaattcaatgttcaatccttgtgattgtgtatctttcaacaatttaactcatgttatcattcaaatcatcaagaaattcagcgaaaggccatcctatacaatggatgcttggcaaacaaccataaattgttacaatggcatataagtagattgtcattgtatatgaatatgtaaaaaaatgtatctactaataaagagaaattaagatttggattccatattctttggttcattagaggcaaggtttcttcttcacggtcccttttttttggaatgcaagaaatgaccccataaaactttcttgggagattgcatagatattgaataataataataaaataacaaaccttgattctatactctttaactttttattaggaaaaaaatagaaaataaattattctcctcattttatgcctgcaaattgattttgtagaacataattaggatgatctcaatattcttttttcttttttttctaagaaagggaagggggctaacccccaacttgccacctaagtattaaagagatttaaaccccagtcatatcgaggaccatagtcaaataactttattagctgccactagaataaaataggttattagcgatgaaaatttttcatcactaataacctattttcgtcgctaatattttatcatcaataattacattgttgataatattttataacagaaaaaaatttcatcgcaaaataatcgtttatttacgatgaaaaatttttatcattaaaaaaatttattttctcaaaaattatttacgataaaatattttagatgtaaaaaaaatatttgtgacgaaacttaacgtcgctaataaatattagattaatagcgataaaaatattttcattgctattaatttaattaaatattttcttttaaaatcaaatttttaaaaacttttagcgataaaaatattttcatcgctaataaggacatttgcgataaaatttttttcatcgctattaatttaattaaaaatatttataaaaattaaattaaaaatattagcaataaaaatttttcatcgcaaatgcccttattagcgatgaaaatattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaataccttctatatgtgcgatgtaatattatgaatggcaatattttctatatgagcaaattgaaatgttctttatgattgctatagtgagggggagtctctttcatttttttctttaaaaagcgagagtaatgattctaattgatgttgtcaaaaagagagagtagagaaataaaatcaagtaataagtaaaattatctaaaatcgagcaataagcaaaattttcaaagcaaatttgtcaaaagaaaataatcttataagctatcttaaaactaatcttcaaactactcatgatgcttactatttaaataactgactataatgtttaagtgatgcatcttcataaatttaaaattcttaatcaatactttatatatgttatatgttatattttgcttttgctcaaacattttatcatcataaaaaaggaagagattgtttctccttgaattgattttgatgattacaaaatatttgagggggttactaatgattttggcttggaaaaagatttattatatttcaagagcaaaactgatttgaaagtctcaagagtaagaacagaagatttgtgatctattggagataatttcatattattttggatatgtattttgagagaaaatcaagtttaaagaaaaggatcgacccttagggtcgatccctgtcaaaagggctgaatgacatgatatttttgcctagcacacccaaaggggacgatcctatgaatcgacctctgttgctgtgtaagccaaagatacagaacagtgattttctattctgcaccacagaggtcgaccccatgagtcgaccccctgtgacggaaactttcgtaatagctagttttcaactctttttgacagtatttaattctcttttaatgattttcaacggctctattttcagcccagattactctccactatccattgaagatataaaggtacttaaaggagaaaaaaagcaagagattcaagcattgattttagccctaagcaaaaagacctcttcaagcaaaaaaagctttcaattcaagttcaccaatccctcaagagctcattcaagtcttcaaccatcttgagaaaaattataaaagcttccttcgtattgtgtaaagtgtatttaaagttttatttgctcattaaaggagctaaatttgtattttcgtgtgattaactcatatactctattttgtcttgatctttagttttggaagggttccaaaacttggaaagattagttcgaaccttgaatcggattgtattgggttggcttatacccaaaaaatatgtgttctagcttgagatagttagagtcgggggtatcgacattgtattcttgattgaatacgttttagtggagttaaattctcaagtaggagcttggagagtggatatagatgcaaggttggcaccgaatcactataaatcttgtttgtttgtattgtgcttacttgctctctttctaaattttttttatcttcttgcattcttgcatctaatttctacaccttgcttaaatcactttttatatatatcctgctcattgttatttaatcctcgtgattctaaattaactttaaaatttcaaaaatccaattaacccctcctcttgggttgcatagctgggcaacactttgtactttatgacttttggccaatccatagaaccaacaatctatgcaaaattgagcaatgagacagattcagagaaacttagagatgaaaagtattgttgcaaataatgatcaacagtttttaaattttttttatttttttcatgtattagcgatgaaaaattttatcataaataataggtatttgtgatgaaaatttagttttcatcatcaatactctattatttacaacataatattttcatcacaaataatctgtaatttataaatttttaaaaatttttattttctttcaaatattagtgatgataaatttttatcataaataatttatatttatgatgaaactttaatttttatcgtcaatactccattatttacaacgtaatattttcatcataaataatttataatttttaaatttttaaaattttttattttctttcaaatattagtaataaaaatttttcatcgtaaataataaagtattgataatggaaaaccacttttcatcgctaatactctagtatctacgacataatatttttatcataaaaaatctataatttttaaatttttaaatttttttatttttttcatatattagcgacaacaaactttcatcataaataataagatatttatgatataaatttaatttttatcaccaatactctattatttatgatgtaatatttttatcataaataatctttaattttttaatttttatttttttttaattttttttaaatattagtgataaaaatttttcatcgtaaataactagtatttatgataaaaaataagttttcattgtaaatacttatattatttatgatgaaactattttcatcatgaatatttaaaaatttaaaattaaaataaatattttattatttataatgattaattttatcataaataataggtatttatgataaattttttttcatcataaatatgaagttatttacgatgaaaattaatttttattataaatatttcattattagcgatgaatttaatttttcatcataaatagtcttattggtgatgaaaatatttcgtgccaataaattcgtcgtgaaaattttcttttcttgtagtgtgcataagctggcaccaataaagttatctcaaaattcatattaacctatatatttcaatggtgtgccaaaaatattaatttcttaacttagcaagatttttcaactatttttttctcttgaattttcttttgtgaagcttttcatgtcaaaaaaatttgtccaaaagttaaatcatgaacctcttgatgaactctaacgagcaagattgtacttggttacatgatagaaaaagatagaataattatttttattctatagaatccctccaaagaatgacctcaaaatttttttttagtttttgttccctaatctttagagagaaagaacataatccttctaggagagagagagagagggagacacaactttattataattatccaaatatagatattttggatacatcactcaaaaatcaaagcttgaatcttgggttgttaagcaaagaaatgcaaccatcaatgaaagttgtagctcacttattattgtttctatagtcattagaggatagctgaaaatgatatttaattagaattaagaatttattggataatagttgacacatagagaaaatttgaataatttaccctctccttctctctattgcacacgatatggcaaagttatttgttaggtttgttaattggccaataactaataaaaaattaaataggataaaaatttataatttgttagaataaaaaataatctttcacttaaatttttctttcttgcaactgaaaataattcagtcaacctatgtctaaggtggatttacaagacttgtttacaagaaaagtatatgtctatatttattttaaagttaaacgatatagaaaattctatgctcgcatactttttttcaattctggtatatagttttaagttttgcaattagcactggatactttattaatttattgttacaatattggcttgtgattaactaacatctaattttgctattaaagtacccccataaaaatgatatgaaaattttgaaaatgacatgaaaaataacataggctttcattcaaaattagaggagaagggggtgagagagagagagaggaggaggaggggaggagaagaagagtagttaggtatttctattttgtttgtagtaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagggagagggggaggagagaaagagattaggatttcattttgttgtgaaattgggtgtgaaagagggataaaattgaggtttgcatttggaaaaatgcaatgaaaactcttggaggcttcaatatggtcgaaaggatagctagcttagcaacatctatgatctctgaagatcaaatatgatgccatcattaagttaaagctagctacataattcataaagtacaaggaacctagaaaggagattcttgcaatatcgatcttaaaagatgtgatttttttaaattattaactgacattaggaaagctagtagttattgatttagtggaaataatattttgcaaaataatgattgtattttttccaatgggttgaccctagtatttgtgatcatgaaaaaaatgtggctatcatattattgagtaaccagagggaggaacttaaaaagaagctttgaataatggaggagatgaatgaaactaccagaaaaaaggtgaaaatattgaaagagaagaccattaaaatatgaatattaaaggcatgagattgaaaaattgaaaattgagcatgcaaagttatagaaggagaacaaatacttaaggcatgagatttcaagatacaaaggaagagagaagatgtacgttagggccattgtcctctcatggatgatgatggtagtgatttataaattgttatagagggtgaattgaaaataaccttaattattctagccttaagttctactatttgatgtgaggcattggttgaggtttgaagtgagttttgattgttgtaattttatggtaagaaatactattctcttgttttgctaggttatgtgtgcattgaatatcaaataacttttatcatatactcatgttaggctaaggatatgaactatgatgaatgaatatgattatgttattttaagaagtgtgttcaattaattatgaagtttgctttatgattatgttgctttatgaatattaagtttgctttatgcattttaccaattttaaagcatgtaagttgacccccaaaatcaattaagatacctacataattggttactaaacatccaataaagaatatcaatatatggaagcatgcttaatagcatatgtccttttgtttctttttttttttgttaagactaacgattcacaccgttctagtatgaaaacatctaagaaaattcgaaaaaaggacatccctgagagccatcggagtagccataatattagtctatacaacattgacaaagtgctcaataatataagatactacccaatcagtacttctatttatcttgtgatacacatacctcgcaagaaatgagatcccctcctttgcaatccaccaaatatcctgcaaagagcagataagctttggaatgcctatgctacatcttaatccaactaataataataattgtggctaagtcacccttcattagaatggagtgagctcctaagatgcaccaagcataagtgcagctttgttgggcataacgacttttgttaatcttggattgttcatccttgtcctttcttttgttccctttaggccttctaagcatcttcttgatggaagaggataaaaattattggttcattattcactcgaggtaacatcttttggtcattcaatagttacaaagtacactaataagtcatcaagtatgccttcttcttgttgtaattatcaatatatatttttaaatcttgcttcatccaattaatgtatgagattgtatggatacaaggtatatcaattaagccccactctctatataaataagatatctgattaaggtccataatatattttttatctaaaactctaactttaaactttaactctatattaggctttggagtacaaaccgtagaccctactttagctttctcttgttctttttttattcgtaccatcacttgcttctttttatcatcctctccatcaatacaacttttatatcttctagcatatctatcataggattttgccttaaacaatattgtaaccattaaaagtctttactagattattgacgaagatgtcacacttgaaaaagttattaataaatactttatagaggtggtgtggactctagtacatataaaatcatgagcagtagccttccctgacaagtcttgcatatctttaatgtcatcattaaaatctatcagattgtgacctttatagtaaccaaaaatcatttttcaatgcatagccaggattggattttttctagttagcatatatgtgtctagcatagttcttttgctctgcatatcaaattaagtttctgactgtattaagaaggccttatgataaataaacatcacatattaagatattaacaaaatacaaaaaaattaaacaaaaattagaaaatgaattattaagatactagttgaagtactttttgttggtcactaattattatgccactatatccatcatgaatttcaaaatcatcaagtagtatttctaagaatcaagtctaagtactctcattctctctctccacaactaatcaactatagggaatatttggttgttctcatctttttctatagcatataaaagttgatcctctaggaatgtctttgagaaacaaccatctatgctaatgattaacttgtactctactagcaaatctctctttaaagcatcaaagccgtataaaatctataaaaatatggccttaccctaggaaaaggtctatcaacttcaacattaaaaatctatttttgtttgttcttctttcttttacattataggaccacaaattgctgtaataatcttttaaaaaacctctaggcattgtcagtgcccttcacttaggtctatagcattagatcctacttatagttaaaacatatttctcttttataccttcttccatctctttcctaatccaattagaattaatcttaaacctattgatgcattcctaagcaagcctcaaaattagcttatctagtccttaaatttctacaacacctctatatattttcaaatattttcacaataaataacttttccatctacatctagcttgcatatatcttccaaggatgcttgtttacccatttggccttcatctttgtttttatcactcctttcccgtctaataatattgcatttattcactatagcatatctcttaacaatttcattaaattaattagggtcctaaaatttcatccttagttcaaactttacatctcttttgtcattattttgaattataaaaacaatactttactctcccatcccttctaaacttaaactactcgtcctcagtttggagttaggactttagcttcatattcactttgataattaaccattcaactcttttatctttttttattaatctatataaaatagataggttccttagctttcgctataggagcattagccctattttgaaacataccaacactttcgaatgtatcaactccactaatgcccttttctccaagagctttttgcttatatttagcttctagatattttcatcatcttttataagctcatcaccactcaaattatccttaattctgttccattggcctatagttaggatcatcatcttcatcattagcaaacacaaactaaacatcacataaaggactatcaataacaggcctatcattcaccacaagtgttacaacctgtctatttgcatcattttcactcaaagtaattgcaatggccaaagtattgacctctttatttttatccttgaagtcctgaataactacaaaaattttatatatatcactatagtcctatgttaaagggtaatgtgtaccatgtctatcactttactatcccttctgacttctctaatattctcacttagattcatgtttaaaattttatatcatattcttgacatctgatatcctaactctctgatcatgtctattaacttaaagtgtgaaatgtaacaatctaaatcaaaattatcccatatatcaatctttctttttaggtatgctatttctgattacatttataaaacacctctatgttgcatcggcctgttaaatctttttctcattttatatggatgatgaaatcacaatatatattggtaagcaataaaatataaaatttattaaatcaatcaatatcttactatgcattattttaattattttattttaattactcagctattttaaacaatatcactaacatgctatgtaatacatgaaatagtgtacaattttttagctcaacttattaacatacaacataactattatttcaatatgttcaaatctctatccacttaattgtacaacacccaattctgataaaaagtttacaacacccaacacctaaccgagtcaatatttgatgatgcagtactaaattatttaattaatcaagctcaataaacaatacttattccatactagggtttataaaaccttaataaatccctaataatccctaattgattgttacccagcttatttaaacaaacaataggcaataaaatataaaaaggactcacttttgtcatttggcataaagagctttatggcttttcttcaaatagttcaataggggaccaccaagagacaattcaattactcttttgttgctaagctagctatcctcccgactataatgaagcttctaggagcattctttataatttccaaatgcaaaccctaatttcatccctcctgcctcacctatagttatctcgatccctaatctcctaagtctggcccttcgtatcaatttctttctctctccctttccctccctcccatatcttcttttataactatgaaagaaagcttttgttatttttcattagacatgggcatcgggccgagccacccattacacggtccggcccagtatgaattggcacgtctcacttactacagtaacagattgtaccatatatggtacatataagggggttggactaggttggaggttttgcggcccgcagtccaggcccagcacagccaataagagcctgggctggtacaacccatgggtcaggcatggcccgacccatgtgccagctcagcccccttaagtagtcccatataaatagtcccctcctcttccattctcatcacatcaattcatcattttctatcatacccatactaattctctctactattatttcttctattcaattgctaaagttttcaataatccgctatttttttttattttaatttatattttttatattagtcatgatatattctaatgatagtaatatttctaaattcatatcatgttcaaaagatgaagtcaattctaaagaaattaaaactcgatgagaggatgcatcgatacagaattttaagcgagtaagatcatgtaattacgaagaagattttcttcagaatgagattttagaaaattttgcctcaaaaagcatgctcctacaagaagaagagaaatttcagtcaaatgagacaagcatcctggttgtggtcctcctacgaaataaaattttcatcatgtttctaaatcatttggttcttttaataattctaagaaataaaatttttcatgcttttaattttgaaaaaattcatcattcattaatttttttaattttttaattttaatatgcattaatattatgaatactaatggattaaagatacaatttttttcattttatatcttctatctctcatatatttttattacttaatattttttattttatattttaaaaattaaaaaaaaaaaagactcattaggcctatcagacatgcgggcctaacgagccaacggcccatgcctagcacggccggccatgcttgggcctagggccatgtcaggctcaagattttatttaaacgggccgtgccaggcatgacctgtttactacatgggtcgtacttggcacggcccattaaaccttcagcctgatgggtctgggccgtgcctagcatggcccattgcccatctctatttttcatatgatttctaaaatttttttgtcatttccatggagacatactttagtggcaaaattacatgctagttgatggcaagccaatgttgcaacaataaataaagtatctacctcttgtcaaaattgaaacaatatgttggaattaaaaatatataattatagagtatattgtgtcattagcatttatcttaatgtatgtcatcaagtccttcaaggaagcttttgggccacgcacacatatccatagtttttgcattgaatccattccttcaattggccatagtttaggagggttagttcactactgcactgtatgccaataaaccccatccaaagagagaccagctatctgaaataattcaaaataacaattttatcccctaagatagatgacttatcagctgctagggaactagtttgcctagttattttgtggacctagctgaaggcagaactggcaacatatatatcgaagatgaagctttctgaaatcggaccctgaagagcagaaccatcaacatatatatttagaagatgaagttgtccaaaatcgaactccaaattttggcccagcatttgagacctatccagcttacggcatgtacgtcacatagggctcaatagttgctaaggttaatggaggctccgaattgcttcaaactctttcattcgcacaaaaagaatgatttatcttcttttgtaagtttagcactagattgtgttctcaaaacactttaaacacctacatttatcggctacatatataatcttgaagcaactattgcacgatccaatagtagattcacgtgaaagatcaagattaatcattctttggtgggaaagatgtaccccaaacccctatgtcaacctagtcatagaaaatttcttacaattgaagtatgtaagaaaatgtcaattggttgtataacttggaccagcatcaaccatatgctgagatgattggtttgaagtggaaagaggagcttactaagtttcatatttcccatcaaaatctaccttataaagtcgtgggaacttcgtataacatggattggaaggattctcaatggtcatgaatcccatgaatagttgatgcccaaaagaaaaaaaaaaaaaaagccttatctatatgaaccgattttacgtctaaaagaaagtctataccctatgttaaaatttcaaattattgaatttcaagtgggctccgaacatatgcaaccataagaaaacttgtaaactacagtctacctttgtacgtacccaaaaaaataaaaaactacagtctacctattgtaccattaaacaaaaaaaaaattcctagattctgcctagctgattgtctttttcatctagaaatctggtcggtagctactaatcaactaacaaagcaaaatcatttccgtagttaagaaacatgtaaacgagtccaaacgaatgagtcgtctggtaagcattttctgaacccatgatttctcctcttccccatcaatgcaagtaatttaatcaggctcctttctcagctcattaaataagaaaaaattacctataagtctctagattgatctaaaattacttttaaatctctaaattttttagattccataaaaaatctttaaactgctaaggaattatttctagatccctgtcttcacacaaattggttacacagatctatactcagattacacaaatttatgttcaagttatataaatttatattcagattatctgcataatctgcgtaatctgaacataaacctgtgtaacttgaacataaatctttgtaactttaacatggacctacgtaatcaatctatgtggacggcaggaacctaaaaataactccttaacaattcaaaaattttttatgaaatctaaaaaattcaaaaatttaaaagtaatttcaaatttatctagggacatatagataattttttcattaaataaccatacatgctttagttttctcctttctttatcgattcatccgtcattctctgcaacatttcttgattcacaaggctacgtccatgccttaattctcacatcacaccttccacccgaggcccaacccaatcaccccataaataggggtcctcttcccccttcttccctcaagtccatcactctctttcccagctccaaaaagtcaaatcccccttcaagccaataagcaagaaagcaatcatgttgaccaagtcttccctcctcgcccccttcatcctcctgatctttctcattgcctcctctctcgccgctgatcccgatatgctccaagatctttgtgttgccgatttgaactcccgtactttcatcctttctcttgttaattaacaccataatacatatattcccgtcttagttttaatattttagtccttttttttttttgtgctttttaggatgaaattaaaaacacatgcatcaaaattaaacacaataattaagcatgttttggctattaattgtagcaatcatgcttctgatgattgacgatgcatgcactgcagctgtgaaggtgaacggatttgcatgcaaagccaacgtgagcgagggcgacttcttcttcaagggactggccaacccaggcgccaccaacaacactctgggatccctggtgacgggggccgacgtggggaaaatcccggggctcaacacacttggcgtctccatggcccgcatcgactacgcccctggcgggctcaaccctccccacacccacccccgtgccaccgagatagtcttcatcctatacggcaccctcgacgtcggcttcatcaccaccgccaacaagctcatcaccaagaccataaccaggggtgaggtcttcgtcttcccccggggactcgtccacttccagaagaacaacggccatgtcccagcctccctcatcgccgccttcaacagccagctcccagggatccaagccatcgccgccaccctcttcactgcctctccgccggtgcctgatgttgtgcttgctcaggctttccagatcagcaccaaggaggtggagaagatcaaggctggccttgctcccaacaagtgatcatatatgtacgtaagagagatattagacagcttgcatgaatttgccgttcggtttgtttgcgagaagtttcagacttcaaacttacgaattgttgtgcgcgttcgtaactcttggcttctggttagtttctttggtgctgttctgtaacgtcactttgtttcagggaggatgacggaataataacgttctatatatatattatataatatacggatctcaagtgtgccgatttcatttcgatctgtttctcctgtttctggaatataggcattaatgaggctcccatcttaaccaccaggagcgcgatcacgacagcaaatggaaagatggccactacctcatccgcctttggattttgacgttgtacgtgctcaaccgatgatggccccagccccacctaaaataaaggcttacgtacctcccatttctgtcgtgacctcaatcggttggatcgtgttttgtgcagctctcggagcgcaatggagtatttctttcatcctcatcaagagatcataaagtcgatgtcgtgctttaaaatctatacaaaatatagtccaatgattgaaattgcaaggaaagatcaattatttttttatgtaaaaaatataattcaattttttttttttttaagctttaacgcaagaaaaaaaaaatgttgaaaaggcatgtgtatggctgcatagacacaaaagaatttcgtaaagcgtgagcaagatgggatatccaaattattatcaaaatggtaggatgagagggcctatcatgccaaacttagaacataggtcaaaaggaatgagagaggtgtgcctaatctggaggcttgatgggtgaatctaccagatcgttcaacttttttagacacagagtacagggcctgtctataaatagtgacgcttcttcagttgctatcactgtcggtaaaaaaaataatatatatatatatatatatatcaatgtctagtctttattgttgtgtttctttggacagctcaattcatgctaccatccaaatcatcaagaaaatgaatggtcatccaacagatgtcaacaatgggggctgggcaaacaaactgttacgatggcatgtaagtgggttatcattgtgtctaaacatgtagaaaatatattatacgactagaaataatattattgataaagagaaattaaaatcttgattccatattattcaactttattgcatgcaaagtttcttcctcacgatccccttgtttttgcgatgcaagaaatggccccacaaaactttcttgagggattgcatagacattgaaaaatagcaataaaacaataaaccttgttgccatactcttcaaccttttcattgggaaagggaaacagaaaattaattatgctcctcattttatggctacgaatgattcaataggacataattagaattttctcaatactttatttttttttttaaaaaaaaggagactaatctctagggatgataaaatcaatccgatctgataggtatgcaccctatccaaatttgatcaaatttgaaaaaaagagtttgaccaggtttggattcgaatttggataaaactcaaaaaatatagcacgaatatgagtaaggtataggtagtgctgttttctacccaaatccaaatccgaatctgatccgaatctatgggtataggtaatattcgaactcatattcgaatatatatatttataattctgttttgataattctgttttggttgataatatgcataaaattattttaattatttatatgttctatgttgaattgtaattctatttctatgtttgatttctataaatctgcacttataaattatgttctatattgaattgataattttattttgattgataatatgcataaaattattttgattgtttatttttttgggtatgggattggcatgggatgtgtataggttaagtatggagaaatggattatccgtagatatctccgaacctattgggtatggagatgggtatctcttttcttatctgatcggatatcggatagtatttgagtatagagtattaagttcaaatttagagatggataatataatacccgatccaaatcctacccattgccatccctactaacccctagctaaccatccaagcattaaagagattcaaacccaactcattgtgagtactacagccaaataacttttttaactgcacaagccagcgctaataagattatctcaaaattaagactagcctatgtgtttccaatgatgcgcccaaaacattaattcgtgagaattcacgacaatgtctttttttttggtgaagctctccatattaaaaaaacttgtctcaaggtcgaaaatcatgtaccatcctaatcaaatcaccctaataagcaaggttgtgcttggttacataatagacaaagatgagatagttatttgtattctccagtattcttttaaaaagcttcttctttaaagtcccaatatctattttttgaatttttgttacctaatctttctaagatgaaaaacatgatttaagggaaaatccgttttgaatagtgcttgttttcccgactgttgtgctttgagattatcgctgcggccctattccccttgatcgtcagcgatccgattggctgtagcgagcgctgtcaccaaagaagtatggtagatatccctgtgaactacgcagggacctctaaggcaagagctaagctagatttgagttggtgaagggcgatgcaaggccgcaccatatggatctcactagagccttcgccaaagaggtggaggatcttatgaagtggtttccaaaactggtccacttctcagaggaggagttgagagaggagtcagcgagttgggcggccttggcagtggtggcgaggagcttcagtcagaggtggtgatggagatagtggcgagggagttccggctacgaacaagggttaaaagtgaggtcactataagaaaataagatattagcgatggccattagcgatggcgtttctccatcactaataggtagtattagaaacggcattaccgacggcaagttttccatcctcaaaatttttttaccgacggctattagcgatggctgaaataccgtcactaataagagtttttagcgaccaacaatcacgacaaaaaaataaaccatcataaaaaaaatatatttattaaacttattagcaacgaccggcactattaacaatggatttagcagtcgtaaatatcatttaaaatttttttttatttattaaacttattaacgacggcagaaagaatattagtgacggcaatcgctgtctctaataatcattagtgacagcactattggcaacgaaacttgctgtcgtaaaaaatatttttttttatttattaaaattattagcgatggtgggaaagtattagcgacaatatatgccatcgctaatgattattagtgatggcactattagagatttaattcgtcatcgcaaatttttttctatttttctttgaatatgacataattttagaatttaaagtccatcttcatcattcattatctaaataattatcgttagagtatcataacaaaaaaaatcatctcgatctggtgaccctagctatgttgatcaataaaatttattttcgatgaccacgaacgatcgcatgatgatcttatagacagagaccaccgattgatctaaaaatttacaacgatgatctcgatgatgtttatagcacactatcaaaattttacttcaattaaaaatcattattatggtcaatttagtacaaaataattttgaccattaaaaaaaaagagtgatcaaaaggcacacagcgtccgattaagatgattttttagataaataatttttgttaatattttaatcatttatatggtggtgatcataaaattcaaatcatacgtatgtgaatcatccatattaagtatatcttacaaaaatataagtataattacttaaagattttaagaatgagtttcaagagacatatagttttggatcgttcatacacgtgctgtttgaattttacgatcaccaccgtacaaacgatcaaaatagtagcaacaatcatttatctaaaaaatcatcttataatcagctgcttgaccttttgatcactcatttttatttaacgacctaaattattccttgctaaattgatcatgataatgatattcgattaaaataaaattttgatattatgctataaataccatcgacatcatcgttgtaagctttcggatccatcgatggtcttcatctatcagatcatcatgtagtcatttgtaactgtcgaaatcaaattttaatgatcgacatatttaggactatcaaatcgagacgatcttttgtgatgatactctaacgataattattaaaataataaatagtgaagatgaattttaaattttaaaattatatcatattaaaaaaaaatagaaaaaaattagcatgcataaaacttataatggaaagggttattagcgatggcttttagtgatgatatttttgccatcgttaatagttgtattagcgatgaaaaactgactcgtagcgacaatgaaaatcgtcactaataaatttaatttttttaaaaaaaaatttgataataattataatttaattaattaattatcgacggtcattagcaacgactgcatttatcatcatcaataattatgaaaaaaattatttaaaaattatgaaaaaatattttttctgataaaagtattagcgacggctttaacgacggaatgccatactaatacttttaccgacggcattagcaatggccactttaccgtcgctaatactccacctatttaccatccatcgggggaaaaatttttcgctcatatgtacctcatcctctccccttcctgcaattctcctctcatcggtgcccaaacccccttttcctccctccccgccccatccctctggcatcctgcagccccaagcccgcatccctccacgcctgcggccgcctcgaccccatcggccccaagtttgcgtctctccatgcccacggctgcctcgacgaggtcggctcgaccccgtcggccccaatgtcgtcagcctgaccctgcggcccctgccccaccaccccaactcacgggccctccctgctagtctgaccccatggccccgacctgcaccgccttcccacggccccgcctccgcacctttgtttctatgactgcatccttgagccgccaccttgaccccgcggcctgccctcgtgggacctaccccagcacccctagcccatggccccaatcttgcggcccgaccacacggcctcatctctgtggctgcatccccgagctgatgtcccctcgcctctcagtcctgtgcgccagcccgtgcctcagtccctgcacggtagcccaccttctattacgaggattagcaatggcattagtgatggcattagtgatggcattagcgatggctaatgccgtcactaaaagttaatttttttatttaaattatattaattaagtataattagatattaaaaattaattaaataaatattaatttaattaattagttagataattaattaattaattagaagcacatgacttgtgtctcttcatgcagagtgctcggttcgagaaaaggtgccaaacagcattgcaaacacggggctgggttgtgccctacgcgctcaggcctcgagtcccagctggcatccaaggcatccagccctcgcatgccatacatcttcagccatgtggggtggggggctcggagaggcagtcggaggctcggagaggctatgatgactgtctgtacgagatgcacctaaagagtctaaagagagattgatggaggtaatgcatttttcttcttgttgtagttacagggcaaacttggatggccagttacatcgcagacaactgcttgcagccacctcatggttaaaggtgcagaggaacttgcaatgccttattttcaatggcagatctgagctttcttcttttcctctttcccttgtttactttgttgttctctaatttaagtactgcttttaagtttctattttatttttttttaaatttctactcttagttttcgaactaggctcgggtagggatgggggcctcaggaaggcggtcgagggctcgaggaggctgtgatgactgcctatgcaagatgcatctaaagagtctagagagagattgatggaggtgatgtatttctattcttattattgtagttgcaaggcaagtttggatgatctgttatatcgcagacaaccatttgcagccacctcatggttaaaggtgctgaggaacttgcaatgccttattttcaatggtagatttgagctttcttcttttcccctttcctttgtttactttgttggtctctaatttaagtactatttttattttatttttnnnnnnnnnnnnnnnnnnnnaatttaagtactatttttattttatttttaaaaaaattttttgctcctaattttcagactgggctcaggtaggggtggggagctcaagaaggggctaggggctcagagagactatgatgactgcctgtacgagatgcacctaaagagtctagagaaagatctatggaggtgatgcatttttgttcttgttgttgtagtacattgcaaacaaccgcttgcaaccacctcatggttaaaggtgcagagaaacttgcaatgccttattttcaatggcagatctgagccttcttcttttcctctttcccttgtttattttgttggtctctgatttaagtattgtttttaagtttttattttattttttaactacagcaagttggtttctaatcatgattccaaactcttttgcatacttatcataagaaaatctgtaatatttggactcgagatgcacacttgaaaggtagaatcaagttttttagttttaattaacttagttacagaccattggattattggccaacaaaatacatcattttaaatcttgcattgtcatccataattatataattgaatctttcattgccacccatatataacttctttaatgttgtccttgatctacggaagatggtacaccacagcagacctatcgctaaacccgccaatcgatatcgatcctccatcagaaagatcagatattatataagattgttagttggcaactgcaatatatcagcagaaaaataattctcatccagcagtacatgataatatgttggtctgcttttatgaacatggtacaaagttaagatatccctactccaagtattctcatccagcagaaaagctatttttgcttatgctagtttttgatatgttgaattttgaagatcatactatccgatgctaatgtttctggggaaggagaacataaaatcattgcatttatacggcttcaatgcaaccatcctaattataatccaaatttgcatcattgcttatatggtctgactgcaaagatagaagtcaaactctatcggatgataaacactgtcaaccacagttcctaatcaaactattataacgttacttcctacaccaagcatacaaaataccacgttatttttatgaatgtgatacaaaattaaggtatcatgatatacagttaaataaatataatatatagttattttattctggtatacagttaatccaatatgatacatagttattttattatgatatacagttaatctaatatgatatatagttatttttattttcaaaaattatagatcatgtctttccaaggtcggagccattacaactgaggagagagctctcatatagccagctcgcatgattctgcatctctcacaccagatggtaaactctaacactttagatattttggtttatattattttatcctttgctaactaatataatattctttatattagatattttatacttcggttcgaacgacagaaggtcaccaataatctcatagtcacatgcagtagcgatcgactcccagacacagtgtcgtggttgaggatccactcggctagcagcacctctaactcgactggaggatagatagctcaaccatgttcagagccactcataaatactacaacttcaattaatatgtttagaatttagtcattccagagttaacatttatttttcaaaatcaattttgtagtacgtttagagagcctggagtatctcgtgtggttatcagcaccatccgatgcttgatgtcggggtcgatgaatgagttcttcagttggccgtctgaagctcgtgatgtagtctaggagatattttgagtaagtcagaaatatttaatttttaaatttatggtatatttatattctacttattaatatatgcttcgattctatcttgcaagagtattatcgatttgagactccccaggatgaggaggctgatcgttggatcttcgatgaggtggccacacggaggcttcgagatggcatctatagcctcggacagtctgccatcgagcattctggttctcagtcaccatcagactgaaggtcctacggggatcactggatatggacggacgtatgggaggccctctgtgattagtggagcagtgagaagtatttcaataagtgacagagggcccgacaaaatcgaaccacccagcaggatctgatcaggcacatggacagctccgtcggtacatatattgtggccgacagactagtaaaaaatctatatcaaaatatttcactagaattgtgaaaatttttatatgtatgctttaattaatttaattttattgtttacttattgtaaatatgatagttggatgatccactaggtcagctgcagttgtgggaggccacacaccagtctaggagaactggtgattatttagattttagattgcgacaaattactgtaaaaatttcaaactatatttattaagttattacaggatctaatatatatattagaactaatatatttatgaactgtgaaggtgaattatgtggagtatgttgttgcacggcacgacgatgacctatccactcaacacctccgtgaccttgagggacggctcaggatcatcagaggggtgagtaggagctgggtcataggatacggccatagcttcgaccctctagtggcttgatactctttgacgtcctcacaggtctcgacgtcccagacttaaagtgatgtgtacgtggaggagatcgtgtagagacttctgagctagcaatctcagagccttcggaatgccatccatgatacgatcatgaagattctttaggattcgcaactatgtgacctgctaaactcattatctcaaccatcacattaggtaattctattagtaaactcttttacttgttttaagtttttatatttagaagcttcacatatttagacttgtgtcggagaaagagatctggaggctaaaaatttaatctaaccatccaatgatgggttaggggtgtctatagttctgtatcatcgaatgaaatgtgtaggaataatttattcgagaattgaaagagtgtatcgaaagatatgcttatatatcgaaacttattaataatattttatttttcttagtttcaggatgatgggacatctagctctcatccaccagctactggagaggagaaggaggacgatgaggaggatctggactgatttttttattttgatgcattatattttttgatactacnnnnnnnnnnnnnnnnnnnntttgtgattatcatattatctttggattttaattataatagatgttaggaaccataattgattgtgattaattaaaatagaattttaaaaaaaattataaatttttaaaaaaataaaattaactattatcgatggctttagcagtcactaataacaaaatattaaattttttaaaaaataaaattaaatattactcacaacattagcgatggctgacaacattagcgataacaaaaccatcgctaatcattcttaaatttttttaaaaataaaaaaataatgataaaatttagccatcgctaatgtcattactaataccaattattagcgacgactagaaaactcgtcgctaataaaagtaattaacgattaaattttttttaatcaccaattagcgatggtgtgccatcgttaatagtattagcaacggcaaaatgactattagcgacggtaattaactatcgctaatagtcagatttcttatagtgggttgtggggcacgggctggtgaaggggttctatctcttcagatttaagagggtcagagagagggattgggttctcaaacatccttgggtggttaccagataagtggtggcggtggagccctatcgtccgagattctttctgacagagggagccatcagcttgacattggtgtgggtccgactattgcggcttccgatggagtactagggtgaggcggcattgcaaagacttttgcatcgggctggggagttctcctcagtcgacaactgcatagtagagagaaggagggttgggttagattgggcttacatgaggatcgatttctccttaccattgagaccaggaaaacaaatcatgggcctgatggtgtccttctggcaaaggttcatctacgagaaccttgatggcctttgcctccgatgcagatgactatatttgtcggaggtgtgcctgatgggtggggaaggaggtgccttggtggtgggtctgagcttggagacggatgctccagttgaagggcaggggctggttgcagatgctggtggtccacgcttgggggcatccatggctagtggccgtctgccgatggtagcttgggtcagagagaccagtcagcttcaggaggaaggagactgagtcaactcggcctgctgagaccacactgaaggtaaatcaagcaggctcaaactaggtggactcgagaacaggaatggatggctagatcaagtcgactaaaattgcacaacagtgattgcccatctatatcaggcccaaccaatgatcggatcaggcaggatgggcactgagatctatgcagatagctccacaggcctgagcccttatgcggtcaggcccatgaatcactttagcttggtattgggctacaacgtaggcgagggaccatctacgggtgagtgggtgggttttactggggcggtctcttcccagcctaagagggcccgaccccctgaatttgatgtgggtcgggtgcctatgaagcccattgggcaaaattctgggaccaatgggtctagaaaaggacctgctaagctaaacaaggctaaagacaaggctctgatcctcccgaagaccctcatgaaatcagcaggtggcactggagatcctggagtcttcatcttctcagctacgacctgggaggaggggaggaccttggtctagccagaggaggtggcatctgatccaaggcccctaactgaggtggggccttggatgctgttgtccaactgagataggccgtctagggggagggatagtccatctgtgatgaatctgacggtagctagatcagaggtaaatgctcaagctaaggagggttctagtgcagactccctttcccactagctgtccgatgatgatgctgatttggaacactcagggggtggggaagctctcattccaatcaacctttggcagattgatccaacagcatggccctaaaatatgtgtcctgctcgagacttggctctctggagtgtgcttgcatgagtcagacagtgaatttcgatggtgtggagcacttatgcagtggagtccaggggcctatcggaagggatcttggtgatgtggatgcatggtccgattaggatggatgccttttacaaatatgagcagcaggtagctttagtcatctcagagtagaccagaggaccttgacttctgttcggagtatacacaaacactgagcataaggagtggagggagatgtggtctaagatcttcgggattgtgtcatagggcccgtccttccttatcgctggggacttcaactgcattgtaggaccccacaagaagatggatgataggcagtatgcaaacagtattgattctagaaagtttaggaagttcatcgatgatgcggatctgattgatcttagccactctagatttagattcatttggtgcaataatcgagaagggatagctagggtttgagagagaattgattgggctcttgccactacagactagctctagcactttcctgggcactagtccagcatctttcgaggatcatgttggaccactatctgattttcatcaccactgacggccagcatatatctaggggcccgttcagatttaagaagttctgaattttctatctgaaatcatgggatttgattagggaggtatggagaatactgattcatgaggatgtacggtactgggtgtctcagagattgaaactagctagacacagactcctccgatagaacaggcttgaggttagtaacatcttcaagtagactgaggaggtgaaggcggacattgtggagctatagatgagagaggattaagaggaggacctccagaagcctaacttaagggagctacgctgcaagctcttggtgcaccactctttgcttaaacagcaggagacactatagaggtaaaagtcgagagtgtagtggattagggagggagacaaaaatatcagattcttttactagttcaacataattcggagatctaccaatcgaatcagatagctaagagagagcgatagtatagtagtggatgacagcgaggagatcaagagacagatcttttggttcttcagatcatgatggatggtgcctatgggcgaggacaccctctttcaagggtcccaactagtgactcgtatcttcgatcagaagaatgagattctgacttatttggtgtctactgaggaggtgcgaggggccctttggtcccttagggaggataagactctggggttggatgggttccttcctcttctttcattggtattggcctattatgtgaagagcggtagtggaggctatgcagattatctttgacttcagaggtatcccgaaggagtggaaaaagactctgattaccctcatctcaaagcattcaaatgtatctaacttggggcactttaggatgatcaattttagtactattctctacaaagtatgtgccatagttttgatcaaatggctgaagcagattatccctcatttgatcagtccagaacatgatgcttttgtgagcgaccgatccatcatcgataatgtctgactcatccaggagttttgcatgatctatggtatgtccctagctactgaggtctcatggtgaccaagctggacatagagtagatgtatgatcgattgagctagcgcttcctgtggcagatgcttcagaagcttgacttctagggtaggtggattgattggatcatagattatgtggagcatttgagttttgccattctaatcaatgatgccccgatggagttctttcactcgatggctggaccacgtcaagattgccctcttttctcttacctatttatcttatatactgatgctctattttggacgttgagagcagcggttcagaggtcgaagctagagacctactggcttgcccctggcgtccaacctctcttggcaccttctttttgtagatgactgccttttgattgactggacctcgatccgaaatgtgaggtgtttttatctatcatcgaggcctattgtcaaaactccgaccagtggatgaatctgcaaaagtccacaatcatcttttgccctaagatgaagatctagataaagcagacgattcagaggaggctagggatctgggagcagatcgaagctctgatccatctgggggtccccatcattgatcgacatcttcgaagaaccgactgtaaacctatgtagcagcaggtctaggatcgtcctgagggctggcaagccaactcattctctatgatggatagaatgacactcgtgagatcgattctgacttccatactagtatacctcttggcaaacataattgtgtcgagctagtgtcttaggtggttggagcaattattctaaaattttctttgaggctttatgcatgattgtcatgggctccacttgctatcttgagagataacctactagcctatggaggtggaggctcgggatttagtattttttgttaggatagatgctttgatcatcaagcatgccgtcatattcctcatccagtcgactgtttgtggagcaagatgatgagggctcgatatggaccgtggagtcagagatccaaagttccagctcctcgaagctattttatcatctagaagaagatttgtgctcacactctaatagttttggctcaggtcaaatggttgattggggatggaaggttggtagatgttaatcaggatgcctgaatttctaacttgcctctttctcgatggccgacttacgtcagtatggagatggatgattggcttcgagtctgtgacctgctcactacagacagtagggattggagagcataggacatcgcctgtctcttcagtggcccgcttgtggatcagattctcaccgtcccgattcctatccatcgtagtcaggacgagggtgtggggcctttcttgctacccgagagctcccatgagagatctatctgaaatatgcaagcctacaatgagtatcaagattgaggcagcttggatctagagagtggctgctctttccaaggtgaggctatttctttggaaggttgtctaggaccaacttctgatgtgcactttactcagtgacaggggtatggagcttatgatctcccatccagtttgcaagttggagcataagtcgatggagcatgccctcctgcaatgtctgagagcgaggctgatctagaggaggacgggtggccagttgtgggaggtgagcaatgatccttggttgaaccattttttggatgcaatccactagagtactgttgagaggtcaatctatgcctggggtggaagaatggcgtatattgcctaccagatctggctctccaaaaatagcttggtcttcgaagcaaaggtggtacctactcatcgaattctagagagagccttttatttgaccatcgagtatagctgctttgacgctaatggtatgttccttaatgtctctaatttttggagctctgatgctgctcctgtagcgatttgaaggattattttcattttttgggataccctcttttgggatatatcaaggtaaattttaatggcagcatcaaagatagcaggggtgctgccagttttatcatctgggggtcggatgctagattgctagtggcaagaggattgtatctctttgagccttctataccgagtgcaaagcttcacaccacatgggctagtatgtctgtgcccaacaagagctacgagctaagaggatcatctttgaggacgactctgccaccatgataggctagatttaaagcaatgcaatgcaggtagatgaccatttactcctttatgacattcggacttgccttcaagacttcacggtggttttggcttagcacatctttcgagagacgaatagtatcgctgattggatcacctcttatgtgactaagcacacagaagactagatctggcatcagagactgacttgcccacgagccttacaggatattttattttttgaccttttaggatgcactcatgctagattggtgtgagcacaagtttatacaaaaaaaaaaatgattattttaagagagagagcgagggagagctaaccatattacaattattgaaatataaatattttggatctactactcgagaatcaaagataaaatctatgattgtctgccaaagaaatgttaccaataaaagttttgagtcaatcataaaaggtggaggatagctggaaatgatatctgattagaagaaagagtttatcagataataattggctacatagagaaaattcgaataacttatcttctccctctttgttgcctacactttgacaaagctatttgttaagtttattaataggccactgactaaaatcaaataatctaggataaaaatttatgattggttagaaagtaatattttatttatattatccgatcttacaatcaaaaacgatggacttacaaggcttatttgcaagaagagcatataatatttatcttaatgtatgccatgaactccttcaaaaaaattttcgggccatgcatgtatacgcaatatttacatataatctattctttcacacggccgtagtttaagtgggctagtggactgaactatatgctaataaaccccattcgaaaagagaccagctatccgaaacgatcccaaataatgttcttattctccaagatagatcccttacaagccacaggagaaccaattcgtccgataattatgtgggtctgaataggaatggagttgtcgacatatttaatagaggaagatgtttgaaatcggatcaacttacattcatgcaaagtagggccaaatttaatgtgagaaaatattcgttacaacggtggtattatatcactgttgtaatctatcaattaaacattaaaaataaataaaatatactgatagtataaaatatcatctataaaattgataaaatatataaaaataataaaacataaaaattttcattcatttattacaaatttgatcgtctaccttacgttcatgcaatgcaaagcagggccaaacataatgcaggctcgctgtagagacagcaggggtcccatgcagcattaatgttgctgcatatagtacattatgccttaaacgtttaaggcgtaaaatggaccagcgcattaatattccaattacgttaactgggctcctcgccctttcttcttgctaattctcaccaattaatggccccttttatttttcttcctctttattcctccaacctcctcctctccctccatccccgcatttcttggtttgtacggactttactctgacatcacaccttcctccactctatcccccaccccacccacccacctataaacgctctcctccttcctcttttaattttaacccaaggtcccccagccaagcatctctcttgtgcctccaagaagtcaagtctcccagccagcaagcaagcaccaccatgaagaccaagtactcctcctttctcatcaccctcttctctttctgcctcctcctcctcgccgttaacgttgccccttgcctcgccgccgatcccgacatgcttcaagacatctgcgtcgccgatctcaactccagtaatcccctctccctccccttcccttccccttgtgagctacctcatgatctcttggtttggtttggtttggtttgatgatgtaattaattcccggctcgatttgcttctttgtttgatgggggccgggtgctgcagccgtgaaggtgaatgggttcccctgcaaggcgaacgtgacagaggatgacttcttcttcacgggattagcctcccctggcgccaccaacaacaccatgggatccctggtgacggcggccaatgtggagaagatcccggggctcaacaccctgggcgtctccatgtcccgcatcgactacgcccccggagggctcaaccctccccacacccacccccgtgccaccgagatgatcttcgtcctctacggcaccctcgacgtcggcttcatcaccacggccaacaagctgatcaccaagaccatcaccaagggcgacacattcgtcttccctcgcggcctcgtccacttccagaagaacgacggcgatgcccccgccgcggtcatctctgccttcaatagccagctcccgggcacccagtccatcgccgtcacattgttcgccgcctcgccgccggtgcccgaccacgtcctcaccaaggccttccagatcggcacaaaggatgtgcagaagatcgagtcccgcctcgcccccaaaaccaagtgagagacggcgatcgatcttgtagatttatcatgattgattattactttgtgtttggtcttttgttttcgagaggagaggagaggagaggagagggaattgagggagaagaaaaaggggcgtgtgtaagaaataataatgattgttccttcttcattcaatcatatcgtaaagatgtttctttacacctcaaggccaatgatttcgtttctttcccctttttaccgaaatgctcctgctttaaccaacttatatgattattagaagaaggaaatggtccgcacatttccaggatttcctcaaaatgcctccgtgccactttgctcatttggcgatcctgctaaatctcttaaacctcgagtgctaacgatatcaattccaaatgatgacaataattagctcgaggcacgtcctgatgatatactgtaaaataaaataatcctgcccggaatgacgccagccaggcttcaagagggggattattagttgggaaagcggccaaaagacctaatgggtacgatcagattcttcatgtctgctttccaacatcatcaccaacttcgctttaaccttaagcaattcttccagctagcagaactaaagagctcttttcctaaataatataaaaaaaaaaaattacataaataatttaaaatctaatttttttatcaaaataatgtaaaagagaaaaacgtcattttgaatgacgttttttccctgccacgtcacccctttttttttcacaatggcatcgtccgaaaaaaaaaaaaaaaaaaaaacaccatttaaaatgatatttttaaaaacgccaatcaaaatggcgttttttatttttttcatcaaaaaaaaagaaaaaaatcgagaaagaatgggaaaaaaataatttttaaaattttaaattattattaaattaaaattttaattttaattaaaatttaaaatataaaaatttgaatttgtaattcaaataaaaaaattattttagacgatttttttttgaattattttttttaaaaaaatatctaaaaaaatattaaaatattaaaatattataaatattataaaaaaagaaagaaatgcgaaagaaataaaaattttaaatttaattgaaaaatatcatttcaaattcttgtcaaaaaaattcaaaaaaaaatttaaaaaataaaaagtgccattaaaaaatcaaaattttaaaaaaattgaaaaaaataagaattataatttgaaatttaaaagaaataaaatttttaaaattaattgaaacaaaaatatcatttcaaattactttctcaaattaaaattaatttatttaaaaaaattcgaaaaaataaaaaaatagcctaaaaaaatttcataaaaatagaaagaaatgtaaaaaatagaaaaattatataattataaattttaattaaaaaattaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacaacgtaatttgaaattatattttttatttgaattaaagttaaaattcttatttttttaaaatttaatttacaaatttctttttttcacattttttcctcattttttcactttttttatgcatttttttttatcaaattttacttcaaattaaaattttatttttttttattcaaatttgtaattatataatttttttatttttttcatttctttctatttttataaaaatttttatgctattttttttatttctttcgaatattttttaaataaattaatttgaatttgagaaagtaatttgaaatgatatttttattttaattaattttaaaaattttatttttttaaattttaaattataattcctaatttttttcaattttttaaaaattttaattttttaataacactttgtattttttaaaaaattatttttttgaatttttttggcaagaatttgaaatgacgtttttgaattaaatttaaatttttaattttttaaaattcaaatttataatttttatttctttcgcatttctttctctttttttcctttttctatgatattttttattttttaaattttaaggttttttagatattttttaaaaaaattaatttgaaaaaaaaaaattcatctaaaattatcttttttatttgaattatatattcaaatttttatattttaaatttcattcaaaattaaaattttaatttttttattaatttataatttaaaaatttatttttttctcattattttctgatttttttcttttttttggagataaaaataagaaacgtcattttgaatggtatttttaaaaatacaattcaaaatgacgttttttaaaatatcattcaaaatgacgtttttaagttgtatttttttttttttccgaacggtgccaatgtggaaaaaaaaattaagtgacgtgacaggaagaaaacgctattcaaaatgatttttttttttatattattttgataaaaaattaaattttaaattatttatataatttttttttatattatttaagaaaagagctccggaactaaagcatgggcagaccaattgcgataatctttgaaaaaataatgtttgatccattcccaaaaagagagtgcgtcatctgacatccttttctttttatcccatacaccatcttccgtggcagctttcgctgggaatctacagcagaagagaatgaaccttgctcttgtcgttgtacggtaacggtctgattcgaagcacacgcctgcttataaaatccggagatgctcgagcaaatcattacaaacaaatattgtatcggtccttgtccgtcagcaggcattagtttaccataatccaagcacaccgacgctaactctttagattcttcctcagtgctgattgtttcttccgcatggcttttacggattcttgttccaaaccatcgttctctccatatctcgctagcaaataaattttaggccatcagacgaactgtgtttatctgataaaccatcaaggaactggatgtttcatctcaaactcatttcggtctggatcaaggcactaccggtgataccccactaatgaagccccaaaagcaatgattttttattgaaatcatattcgccatgttaggagttcttccatggcctcatcctgttaggatatcttaccttttttcctttgaataaaatgctaggacatctttctcatcgattcaaactgctgctggtagtgaatcactaaatttgtgagggctctatctcttccataataggcattaggtttgcatatagaagaaatattgggaactccttcaaagtaaatggttctatacgtggcttcaaattcttgcacttcagatcttcagtcaggcaatcggattattttttccaaaagaaaaagagaaagatcaccaagtccgacgcgacacaccttcttctgtgtttgcaaaagctatccaaactggagtagaggtgattcacgagatacttgcataagatcctacaagttgagcacatttaaaaaatgatattttagaaggaacaagtgaagtcttgatttatttattccttgatatactgcagatttatatgcacactaacagatacatgtaaatgcaaaaggaaaaaagaaaaaaaaatgaaaactaattcagcaataagctagcaatcatgactcatgacagtcattcaatcaaccagattaggtaaattaagtcaaatatacagcctatcctcttctgctatttctcaacttggtgacgttagcatgctccaccaaaagaaccaatgtcaccatgcactacacactactacacgttgaagccgcacttctttgtgctcctcaagagtgagaaatattagatccatggcagaactatgtgtaaaatgtataaccctttttataccatgctcatttgcatgtaaatgcaggcatgagatagtttttttcagcttaatatgaaataataggcatggcttttttacaaagaactaacaatcagataatggtagcatccagtagatggctaagaaagctaaaatccaggattttgcatccacttcagaaaaagcaggtggagagaagaataagcagtttttcatatataaggtgcacatcacgactttacagccaaaataaacaacagaaaaaaatactcccatatagataaacgaataatgtaataaagcaaaaacaaaaaagctcatggaatcccataaaagagggcaatcgtgtaaaacagaggatcccacacccatggtcaatttccccacaaacaagcaaaaagacccttacagtaatacgtccacataggaaaagccaaggagctgcgggatgtcagtacatatgaccaggttgatccactcacagcttttcagcactgacatgtttccatagacatctagctgaacctaacaacaatatcactaaagctgttagaatgcctggatatctgtttaaagttgccccacacatgtgaaattttttcagtcgtaatgacaaacaatcactaaagccaaaatagaaagcccacatttatgttcaaatttaccatacattctaaattttataaaagcaagaccagaacaaatcactggaacgacaagcagattcacatgtttcgcaatctatgatcatttcaagtaacagcaaatagaattactcatggtgtgaaacatcaacttaaccatccttccagaaggggcaaaactcgagcatccgttagaaccagagcctcaactcttgcacagtcaagttagtcatacttttgccagtaaagaagtgccctttttcttttcccttttatctctcctgattgattgtgttgtcgcaagcctggatagtgacatagaagttggctcgagagaggcacaagtcaaaaaatacaaagtcaaacaatgtgacggcagtaacccatcttccaagcagacaggtttgcacgcaactagtacagcaagaagagggctctagagatatccagaatataccagcacagtgaaagaaccctttttctcaaaatcattcaaggtagctctaaatttacttcagaatacattcagtatagcattatcatacaattttaaacataaaattattgctgtgtatcactactattaaaacatttggcgttttgaacgcaaatttgtcttatagcttatttttccactgaacaaaaaatgtgatgtgctggctcccctgtttttaaacaaattcataggctcacggacttaaaattttacaatctgtttgttgtaatgcttgtggaagtcaataagcaatttacaattatctcctcggacaactagtatgaataagctgagaacagaggaaatcgaaggggtcaaaaaaagagatgtatgtgacatcatctgatcagaactatgtagagaagagtgatttgatattatatggatggttcatttacataaattgacaagttgcggaaagattggaggacaattgttgaaggaacaagaagcaaaagataagcttacttttgagcatagcaggctctccaaaatatataaccaaatagatgaaaaaaggcatttagtttgtaagaacggggaaaagatacagtgaagtctccctccacactttctgaacaagaatttggtgtctcaggtgaataaatacaacctctacccaccaaaaatggattggaatctcaccaattaaataagcgggttcttgctggtaggtaaacaaaatcctaagggcctgttctttgaaaggtaaaaaaattatccggaaatctgtgttttttttttggataagtgcttcatgggcaatatttaaataagaaaataaattacttattgatgctaaaccaaaacaaaagaagaagaggaagaagataagtagcagaataaagataagagaagaaatttagaatagacaatcaaagaagataggtagaaaattctataaattatttcaattctcaatcaatcaaaatatgcgaataacgtcttacaagcccatatttatagacttacaattctacagttggaaaataacaaaattaagcaacacatcttaacaaaataagaaaatatgcaaaataaatatagaatctcgtaaataaaaaaaatcaaaataaatcaaattagcaaattaaaaaaattctaatcaaatcaagatttcaaatcaaatcagtaatttaaaaaaattctaatcaaatctgaatttgcatctaaagagtctagaaaaattaggatatctcaaaacgggtgcctcaattatcttttacttgatcttcctaaagtttgtgcatgcagcgtcagtccatttgaactcttaatttttcatgctatcagtaatggaagccctaatagtattaaaactcttaatgaattacctataaaaggtaaccgactcatgaaaactacgaacctcagaaagattctctgattcgggccactttctaatagctcttactttttcgggatcaactgaaataccttgcaccatgacaatgaatcttaagaaaagaatctgggtctagatgaaagagcattttttgagattgacatataacttctctgctcttaatgtcaaaaaaatctaacaaatgtgactcaatttttttatacatgttcttttgcattactttcccggataagctactaagatctattcatatttttcataacatcctttattatataaatattattatatattacattatactatattatattatattacacggataatacaatatatcataatatataatttaatatagatattatattatatcatattatattatgattatgatattattattattttatattatattatatgatgatgatgttgatatcatacttatataaaatagtatataataatactatatattatattatttttatttttatattattatactagagttaggggtatttaaagaataaaataaaatgattattgttttggttgatggaaaaatgacttatcccccttttagatggataagacttttctcttatttcatacgtgaatattgtagaaaagcaccacacacttagacttggatagtgggctatgcttagcacggcatgatccaggcctgccaagccgctgtcttaatgggccgtgtctggcatagtccgtttactaaatgggccatcctaggcacggcacatttaacccaacctcctaactcgacttggcccgtggcccagggtgtggcgggccgtgccaagcacggcacggcacgtgaccagcatggcctgttggacccaccaacagccataaatggtctttttttatatttttatcatcttacccatcttttcccaacagtcataaaatggctaatttgaaggataatttggaaaagtaaaaatatatacaattttatctcccaaaaaatcataaaataactagttttaggagtactttaggaaagtaaacatatttggatttctataaatacaacatccgatgatgacgatacaaacactactgacgattagtaagatttttattttttattttttatttttataattatactttttaattttttaattgttgaggtgagtcacctctatttcttctctctcccatattgtattctagaggtcagacctagctccccttcctctcttgtactattttgatttttattaataaatcggtagggattcacactaaacctcccacaattacaaagtaactttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgactccgctcaacactcatctattcatgcatggtcagatgctgcttagataaggatttttatcctatatattttttttaaattggactaatcatattcatcaatatcttattttagaagttcaaatatatttaaataataaatagtttaataaaattttaagataaattaaaaaatattatatatatataaggacatccaaagcgtgtatcgggatgcccgatcaggatggccatcgggatgggatgggatgcggggcatcccattccaggagaaaaccaagacactcctgacccataggatttaaaattttagccgcaaacttacaatatctcatcccacttctactaagcatatctaaaacatatgtttattgtgataggaatatagtgtctcttactttgtctaccactacacccaaatagtatttcaactctccaagatccttcatctggaaagtttgcaacaaataatccttcacgacgttgacatattcctgagatgatccggtgataacaatatcatcaacatatataagcaatatagtaattccatgagtacctgtatgaacgaatagaaagtaatccatctgagtgcactgaaatccaaagctacgaatctcatcaaaaaacctctagaaccaagccctggaggtaattgctttagcccatacaacgatctcaagagcctgcatactttcctaccaagatcatctacagcatatcctgatggttgctccatatatacctctttctttaaatctctattgagaaatgcattttttacatccatctaatgcagatgccaaccatgagtaacagcaagagcaagaatatgtctgatagtttccatcttgacgattgggctaaaagtttcattataatctaatccatactcttggatgtatccctttactaccaatctagccttatatctctcaacactcctatcggcttgtcttttaattttgtagatctatttgcaaccgacaacattcttttcagtaggtctatccatgatctcctatatatagttttcattcagggcagccatctcttcatttattgcctctatccatcgatggtccttgaaagcttgcttgtaagaaatcggttcatgctcatgctggagtgcaaaaagatatggatgatactcaatactaaatacttcatataagacccatctatcaattggatgtctctctctgctagaacactgtaaaactgtctctaaaataggctccttctaaatgtcaggtggagtgtgaagtcgctgctcttgctgctcacccatctcattttcaagtctggcatagtctccttcagtagtactcatcagaacatgcctatgataaacttatctatacattatatcttccctatgctgcatggcaccaatattaatgggtagaaagtctgtccttacagcaacttcatgcctatcgcagtgatcgtagtcaacttctgtaatctgcatttatctcaatgcatcatcaaatcatggctggaagctgacacaatcattatctatatagagatagtcatttccttcacatgtatagtagggcactgctcatcatctaaacaaaaattattttcatcaaatatgatattccttgaaatgataatgctccatttttggagattgcaacaacgataattcttgaagtcatcagcatatccaacaaacctacaaacatcagtcttaggagcaaacttagttctttgaatgtcagaactatgaacataacacctacatccccgtacttttatatagtcatacatggaaaccacagcatgaaaaatttcatatgatgacttatgccccaaaaactttataggcagtctattgatgatatggaccgctgtatgaaaagcttcagtccataatccaaaatgggcacaactcccatgcatcatgcttataccactctcaactatatgccgatgttttcactccactataattctttctgacgtctgtgggcaagacttctgatgatgtatgccatgactatgtagataattcttaaattagtgaaaaatatactccccacccccatcactatagaagttagtaataggcatcccatacttattttggatgaaaaatgaaaatgctgaaatatggatgaaagaatgaaaatgcttgaattgggctaggtccccacatatttgagtagacaatttccaaagaaaaagaaactcatttatttattatctgaaaagagagaaaatgactcttacaaatttgacattctggacataataattcattaagtgaatctttattacatgggacataggagaaaagacctttcttgaatatgaactctaagaagtgaataccacaataagtaaagcatcgatgccacaatctggcatcccctttcttggtattgacagtactaaatagtaatgaggatggctttagactgatattagacttagatgaataactatgagcttccttcaacacaaacaagctcccctcgcgaacaccttcagcgagtgttttgttcgttcagagatctttgacaaaaatagaatcaggagtaaaaacaacataagaatctaattaatcacataattgaaaaatagaaagaagacccttttgaataccaagaactaaaaatatgttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatttggatgattatgctctttataatttgtatatgaattataaattaataaaaattatttgatatttttcatcataaggtgtacatctttcttgatcgaattctaatattgtgataaagttcttagaactatataacaattgataaagaaagatttatcgaatagttcttaaatatattcacgaccaaatgatacatcattaaaggacgatgacgtttatcgagtgtaggtcattgtgtgccatataaattgattgtcctcgtaaccaagaagtgtgaagatactggtatggcatacagatgaaatatataagtacatcattacggaataagtgactcacctgtggagcactctactgctaaaagtagctcacgaagaatatggacataagtatcccttcgacctgagatcaccacagtgacttgcaagcaactcactgtgctttgatatcggactatctgaatttttaattcagtgatgaaaaatttttaggtacaatcaagtacttgtggtagtcagtgtgtggatcaagatgggattgacccctccgtatttcaaaagttaatgcatcactatattttaattaagtaagatccgatcggagcaatccatgtgataggtcacaggatttgaaacctgatccttgctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacccttgattagagaaaaaatctctctctgaaaagaaaagtaccatcaatctttggagtaaggatacctcttgatggttgaaaaagagcggaagagatcaatggatggctggacactgaccataatacaaaggatcaaaaaatttactacaaacctaaaagagttcggaacaatggcacaaaaagataaaccatagaaatgaaagagagcaagaatgagaggatgaacaagaaaccttaagcccacccaaagtgcctcctcatacacggcaagccaatcagggggcgagttatctatacatttgtttgccttacgaagttcaatatcaaaatctaagagaatcccatatcaaacttgtatctgactcagaccgtccggattcaacacagagctataaccactaggacctagcttactctgctcgaccattctcaaacaaaagggctaaaaggatatctaatgaaaggaaggaagaacagaaaaatagatggacaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtatctctcaattcgatcggctgctgctggttatgcaaattgatgccataattcaaaaaataaaaattaaaatgacttctatttaatttcgccatgatgatcaagtcatgctgcctcactgtcgccccaaaagtcatgcacatcccatcaattaatgggcttttttgcatcctcgacctaggaaagataaatatactccattcatccgactaaagtcaaactcaagagtaggagaacatgtgttgaaaaaaattctgcatggatcgaatatataaaaagacctaggtctaagatgtccgcgcttagcaagcccatcaattgaagccttcacccactcaagattgactacaacttttgtcgagctaatcctttgcaactacctaatcggcgctttactttctgagcagacgagagtcccgttgatagctactcggcaaaccttgtacattatcgccgacgatcccttgtcggtcgaccaattatatatcattaaataaattttgatgacagaatggggtgcccgactactagtcgccgccaaccaatcctcatctcaataaccttcagttagcaattttattcaaaatacaacatctatcaggcaataactgtctctaaactgataaggcaatcacaaccaccgcatcccgaaaatcttgagcgacaattttgtgccccatgaattacgttctgaccacgcgggaccatgccaaccacttgctaattgaagctccaactttccgttataaaggagactcaaagaggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacatagctaaaatcaagtcgattgaatttgaatttaaatccgattagatcaaaaactctgtattaggggtcctatatcaatgatccgagtcattgaatatgatctattatctcataattgtttgcataaaaaaaattatttgattcgaagatctctatcctatacatcaagtagtcaaaattggacaacctaaataaaattgaattaaacgtattttttgatcgcttgatgcatatgctaaggatcttcaagtcacatcattttttatatgtaaatagttttgagattatagattacatccaacggcttggatcatcaatgtaggaccttcgttatccagttttgatctaactggatctgagcccaaatccgatcgatattatccaagtccgtctctatatatatctataaattagtttagtttaaattaattttttaaaaatttaaatcaaaatcaaatcaattttttaaatttctaaattttttaagtgaaatttaaaatttttgatctaaaataaaatgcaattaatggttcagatcaattttaagatttaatcaatttaattgcgcactcctgtagttggccgaccagactcgaaagccggtctagcccagcagccaacaatcaattgccttggttcaataaattctctcaacaatcaatcaaaagcttccgaagaggaggattcggggaagcggctcctggttttgtaaccgctggtcggaccgcctgacgcttctagatgcgtcccccctcgcccccaactctctctttctctgcgtctcccacgcacacgctttatttctttcttggcaacaaagaaagggagagaagagagagagagagggagggagcaaaaaataaagggagagtgaaggaatactgtttagttgttcgttcggttggtattcagacgaagaaggaggaggaggattaggagatagagaggtatggatggttatgggcgacaaagaggaggaagggtgtcgcgtgggctgctgccgctgctggcgatgcacgtggccaacgagtacttccgcctggagcggaagccgcccgtcacagctgggctcctctttgccaacaccctcatctacctccgcccgggccccctcaaccgcctcctccccaccatcgacgaggtctggttcaatccccacctcatcatcaaggttcgattccctgccccccccttccccaatatccctgatgttgatttcttgtgtcgttccatatctcccaagaaatgaataagctattcacggattttagtggatcaaatctcacaagccgtttctctttctcgctctcgcttctgattgggttatctaactagcaattttccgtaggctataaaacctgtttaataattgataatctttttctttttttctttttccttttttttttggaggaaaagggaacctctttaatactcacatagaaaaattaaacacttcatgaagttggagaaatcataaagctaaaatgtttacacggatttgttgttagcaacttgtttctttttccaaaaattggagaaataattattccttgaagattctgtttcctagagtaatgaagtggttatatcagtatcggtattcgctgggttatgttcacgaacatatgaaattgaagctttaggtatgcaacatatgatcttaaaacaatccagaagattctttcgatgatgttcgaaaagttcaccaagattatatattttatgatgcaaaatgtgtaagctttttcctagaggggtcgtgcgcattttacttggtttatttccccttggattcatgagatttcagttgacatatattgctagtatgataatataaaaaccgtaagaaccacctttttcctccttccaaaccccaagtgcaattacccggtacatgggccttgtgggctatttcaatccaaggcatatacaaaaaccataggaatataatgtctaccaaacaggaaaacctcaatttaatggcagcaatccaagggatatgcttcaatttccccccttttcttttgcaaaaaggagccacatgtatctcacatgtcaagcctcaatgagaaggaaatggtgcctcttttttctgcaattatggccccgttgcctctcctttgagctccacctttggtcaacagctatgcatgaccagcctcttgcattgtgatatatgaagagtgccaacatgaccatcctctgcttaagtaccaactttggctacataagcatccccattggtaaagatctgaaccaacaccatgctcaagggaatggtaatgctctcaatgttcccttgttccccatctttcctctcaagaaagaaggggatataatgagaaagacaggaaaacatgaaaattggagggttcacatgagggaaactagaagttacaaagcattggtagataatggggagagcgtaagagtttgcaacgtagtggttatgtttacaagagaggattccttgagataacatggtttatttggaggtttgttacatattttatggaggggcggaggtggttgggggtgggggggatttgagcacccgctaggaagtccttatgtgaaaccttttaagattatgtgaaaggaggagagaatttgtgactattggttgcatgcatgggagtcttccatggatgagatgggattgaaaatctcttcaagtgggactcttttgacttggttagcttgtactgatataggtgagtatattttaaaaatagttttgatttaattattttgtgggtccagggaacaaattcttggacagcaattatgttgtctaggagtttaagtgattaagtccatgaagggtagatggatccctaacttcaaggacgtgggtattttgaaagtggccaatccaatgggccattgtgctcttaggctttatctccattgcctaactgcatgtgatggagtctggagaggaatgttcttcctttgaaatcttatcgtgttctgcatatgaaggttgggcacttgaaaaatggtttcattgccaaattggtgaagccggaatccacccaacctcacccaaataggattggagctctccaagagttatgatgagtgctagaacacaaagtatattatttgggagaaagggaagaagcatgcttgcatcataataactagattccaatgcttgagaatgcaccatctaagcttgtaacctagaatctcttattgctaggcagaggggtaggaacactaggacatgtccaggcttatacagctcctaagtatatttgaccatgcacatgtctgcaccttcaaaggaaagaaacctgacaagattttttgataaagatgggactcaattaatctggtcaattactataactttttctagaaggaaactcctcatatgaatgatccgctgatgtcccagaaaatattaaatcggccatcttagaacttgaatttcagaggagaaaatagcaataatctgaaagcctaccacttggtgaaccaccattcttgattccaacactttgaatgaagtatactgcctgtattatacttgtccaacatgacgctgtatacattttatatggtgtgttctttgggctgtatgatctggctagcagcttatgtgtatcatggatggttagcttacttgtgcaataattaccctagagatttcctcatccttgccaaaacataagcactcaatcatctttccattttcattttgttattttaaaaattatggtaggagtttcaataatcattcattataaaagaaaatacacatgtcaaatacttgtagacaaaccaaatgttgaaggataaagcttgcatgtcagataagaaaggtgcaaatactgggctgtagccctataaaaagatgttgcattggcatgcatcgtggatttttctgcaaaggctgggatgttcaaactaaactgtgtcatgttgggacttcattttttgttttagtttaaagactttggcagtgatgcgactgatagaaaggaaatggtggaaaggaggaagcataagagtatgtttttcctgttgctattcctgacattttcatccataagtcctataaaaatcggattttcaacaacctaagtcattaaataaaaaaatgatccctgtttaatctttgcgatccagtgtaatccaattgattgcaagcaccaaagattattttcctttgtattcactatgttacaaggagctaagttctattaaatttgctttttttaagatgaattcttgtaaagttattgttgggttgtcctcaattagaggaagagcaagttgggttttctgtaatggccagtgctggcaatttaattgagtaacctactttgattgggtttagtgcgtacatgagtatttagaaagaagtgttagagtggtataactatctcctgaggtatgggattcaggtcccacatctgtacttatgctctgctgtgtcgacatgattacatcaggctatcatgccaagtcttaagtatattgtaggtagtggggacttctccctcaagtcaagtttatgtgacctaagttggaactcatagcagtagtgggaaattagaagtcatctacattgtgtttttgggaaagaattgatgcactacaagcttgttagcatgattagtaaacttatggtccttctccatgttcatgtgttggtcaatcacctttagtctaaaatctggtcctgtttcatgcctaagcaattgcccagttagaactggaagcctttaggctaggaactaggtgttcattttgctaatatccaattgactggagctaggctaattgtaagcaagttggagaagtgggattagaattttagccaattggaatagtgatagaaagaaaccaagtctggaaggtttcaattcgggttttaggggcacttatttcttatgtcctaagcatgctggaaaaagagtggttgacatttttgattaagcagtgtgggaggagatctgcagctagaagcaacggttttggttgtcatagtacagctcttggcaagttgccacttagatgggggcattggaccctgtttatctaacagtggtttcgcctctatttgttaacatagactttgggagaccattgtatctctgtccttttgtttcattgggaaaatgcatattatttgatacctggttctctgtaaaaaattagagacttgtcagatgatgtttctctttcccaattattggcgtggttgggggggagaaaatggttgtgtcattttgctttatcttttgtgcttcttgcttgtggatcttttgtggttgaggcagtttttattactatctggctgattctatgactcatccactgtttgaattttggctggtcttcttatttagtaaagagagcatcaatttatatagtcaagatacaaaaaagtctagaaggttctttgtgtttcttatcttcaattctaagatttccttcctctgccccaaaaggatttctatcacatatagttgtgaacaaataaagtttgaattggtagcggagggcataacctgtgctgattgaatgaattttaaggacaaatgtttatcatgggctgtcaacctgttctatgttatgctgggtgcttaaaattatgcagaataataatctatttgccatgcagtctgaaatatattgcagagtgattagcatgggtgatatgcaaccagatcatgtttagattcagtgagtgattcacgtataccggctgcatatgtagcaatcagattgtttgaaagagtttaacgagtcaattgcaagtagtgatgaaaattttcaaaattactgatttgtcgaaatatatttttttgagtttataaaacaaaagatcatgttgatatgaggacattcgtggtttgaaagttaagaaaatctgtcctaatgatttcagtttgaacagattctgttgactctagcatcaatttaatgacttgctagtattttaagcagattgtgaagtaatgctattttcctgtctttctgaaggtagaaacacaaaaatgcattttcgttcctttgatcatgttatgtagtctaatttctgaatgaattattcatctatctgtgtcacccgcagcatctcttcatctttcagttatcatccacattcattttcaatttttttccctatcacactaagggtgaattttcttttactaacttagggtctttaatactgtcctaagcagtatggggacctgaagcgctttttcctgtcagctttctatcatatgggtgaatcccatttggtctacaacatgctgtctcttctgtggaaggggattcagctggagacctcgatgggcagtattgagtttgcatctatggtagcagcattgcttggcttgtcccaaggcatcacccttcttctggctaaaagcttactacttttctttgactataggaacgcatactatcaccagtatgcagttggattttctggtgttctatttgccatgaaggttgtgctgaatgcccagtctgatgactatgcttatgtgcatgggatgattatccctgcacgccatgctgcatgggctgagttgattctcatccagctatttgtaccaggtgtgtctttcttgggtcaccttggtgggatacttgcaggacttctgtatctccggctgagaggttcatattcaggccctgatccagtcactgctatgattaggaatgtcgcccgaattgtaagctggcctttaaggtttgtccgtggcttgtttggattccagcgccaccgcatatctggaagggggaggattggacgcagtccaccaaggggagctgtgtctggtgtgtggagatgcccggtatgtacttatgacaattcagcatcggtggatgtctgtgagatgtgcaacacaatacgtaggggtaatgggttcggcctgatgcgcacacctgatcgaaccagtgacctctcagtggaagagctccgtcgccgtaggcttgaaaggtttgatagatgattccacaggttggtgctgataaacgctggcttctttcagaatttgttgtatctcaaggagttcatggctagtggctgttgaagaccttaagaaatggaattagatgttggaaatgcaggggaatttgttttgctgtattcatagatcaaagaatcacatttggatttccttgaacttcaacgaagaaatgaaaacaaggaaagcattctgttggaacttagctgtgattttttagttagaattgatttattagactgcacttctaacttcttttcatattgcttcattttgccaactgttgcattcattgcttgcattcacttggaatccagcactttttcgtaccacaagaaattttaccgcccaccactaaaatacgacgcctggaggatctctcgccttctgggaggaatgacttgtggttataatcatttctatattcaaaaaatcataagcagcaatctgcatgctaattttctgatttgaaataactttacaagatttttatgagagatctttgtattttctgttataatgcatcgctgtgcaaaatatgttgattccggtagagagatcttttcattgtatgagcatttggaatgtgtgcatattaatgacggtgattatcagaccgatatcttatcgtaacagtcattatatttacatggaaacgatattacaaattctgaagtacgtgccagcaaaaaaaaatatatttttcttaattagatgaacggtactgcaaataaataactagtaactatgtcgtctttctatgttctcagaaagttatattatccatctaatgctgctgctctgttgtcgcttatcatgaaggcatacaacgactgtcgtagaacctgttgttttatcatcacataaacctagcaatggtatgaaatgtaaaacgctggtctcgagttttgttgtagcagcaagtaacaatattggatggtacccactgggtggatacagtgtccatggacatcatcgaaacgttgattatatgcgaagccatttatgacatggacttagagtaaaatggtttaatgtagttattagattgactgggagaaagtaattcaactttgtcgaatcccttggagtttttcatttctatgtttatgttctttgcctttctttttgagaaccactgagctacttgctcaggtattctgtttttcttttataatgtgcgcttccaagattctgagtcacattccaaaagctttgtaatcttagggacgttggttttgtggttttatttatatacccctacggtttgtcaatttctttctttttctaattttttaacgtacacgtgcgtggcgctcatctgaaccgttgatgtggatccaaagattattattatatcctctcacattaagtcactcctctcatttgattcattctcatatatatagagagtgtctcaagtgagaagagtgacttaatgtaagaggtgagaggatataataataatttttggattcacattaacagttcaaatgagaatgcggttgtccaaactgtccaaatattcttaggatttatctattccttctttttctaattttttttaatacgcatgcatcagcgtgcatggcgttcatctgaatcattaatgtagatccaaatgttattattatgttctctcacctctcacattaagtcactcctctcacttgatacgctccctatatatatatatgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaactcttttcaatggattggaataattttactctaactcaacgagtattgtcaatcttgaacaaccctagtgaactttcataatccactagtgatacctaacagtatgtagtggcaatccaacagaaccgaaaaagaacctcaaagtgtagttctcatgtgattcagtccctctatcatgagtcccaacttgatggcagatcatagataaatcgtcaaacctcatcattagtcatatgatagattcgattagcttaagtccaattgtgattatcataaaaaaaattttcatcaatcacacagctgtggccacagacttatggacttagcctctcaaatcctatagaactactcttttctatcaagatcaataaatttcatctagatatgcatcttactcctacactggaccaactgtcgtcaacatccactacaaaatctcaaagagaccatatttctatatcaatcaaacttcagtagtcttacaataagcaaccataccatcacagatcaaagaatcattcacacaactacagtatcgagatgatcactgatgattgagtagaaatctacgtgatctcttatatggtcacactcagtactaattattctctaacaactatccacacttgttgctcaatatctctacactatagatcagagactcatctattctgaaggaagcgatctgtgcgtcggtctatctggatcgatcggcattctcataatgatactataatcagaagtaatttaaaaattaattatacatgcctataattctcaacatcttgagaatatgtatggtaagtattaattttatggacgattcaaggatacatcacacttgaatgaaaataaacttatcattttattgatcaaatcaatattttaaatacaaaattatgtcttagtgttattataatgtgtcagctatattggcttctagaacatacatccaacaatatagtgtttaggttgttatatatattcatagaaagttatataaggcattaagaagtcatatatatttatttaaaatattatataaagacacagaaagtcataatatttttctatctttgttctataaagatatttttttcaacaaaaatctgactcaaaaaagttgagcagcattaaatgtctatcttattattaattacgctacatagtccaatttgatttgacagtgtgctccacatcaatttgctataccacacgtagtgtacaaagaattactcttgggtaactagatggatgggtgagttacaagctcttgggatctacggatcaaaatatttggattcactcgagaggattttgttcctatagaattaatgctgggggtctagctacttaatcatttgattcttttgctgcatcagacgataaggcattctatcttacaagagctgctggtatttacttgtgaattatagttatatatgttagatctcaaccttatagaaaagatcataagtgctttaaaaaaattctttcgcatattaaaattttatgaaaaaaatgtataaaaaatatgctggtgccaattagagatttttgtagagttaattatgctaacagacattgcatattctattcaaaaagaaaaaggaaaaaaaaacttctcaggagatgatcatatggacacgatattgataagcaaaatagaaggaattgtaaaaaaaggataagtacaatgaatgcattacaaggagatgacaagtcaacaaataatgaattgaacattctactgcttttcaatacaaaattatcaagatattacaagctatcaaaaatattgattatggctatgatgaaatatttatattagccaaataattaatagaaattatatacttttttaggtagtcatgtagatagcagaaatgaccattcttacaactaagtaaatatgctcgtgctttttttttctattttaaaattctcaaactattcttagcatacacttataaagttttacttattcctaaaatatatttataaaattatgttttactaaatctaaaatgtatccccaatatttccttctttttcactatattcctaaactatgtttattgttcatggcagatgaacctatatttataacagacataccaacttatagctaagtttattatgctaaaagatataaatatagagtgctacaaaggaaggaaaaaaaaagaaaaagatgactacaaagggtggagtggtttgctttgaaacatatacttatcttcttactctattttaagcactaaatttgaattattcttttttttttggtagaaggtggcttgaaggctatattaatacataaaaaaaatttacagagcttgttctttataggagaaggcaaaagcaggagcaaaagctgaggcatggaacaattaaataaaaggttatatatgtacaaacaattacagacccaaatctcagaagtattcagataaagtcttatagaccccaatctatataaaaggcgtgaagaaatgttgtagtctgaagcagtgaggtgcagttgagtaagaccaagaataagcagctgaagaaccataaaacaaaaggatagaaccacttctttgtgtagagagttaccataattgtgaatagtacaacatataatattgttgttgccttgtctttgaagctccctagaaaacctcttgcatccgtactagcccctgctaaaggcccaaactgatgcatatcatgaatagttcgcccatatatatggttgcataatcaaagaagagggggtgagggatattaatagcaatctgtgtctcttggaatgagtaatagtttaaaaatgacgtgaagaaaaatacaatctgtctccttaaattctcaaggctaagagaaaacagtccattgtagatgcacctgaaataaagaggctactgttgaaaataaggaagccttgctgttgttgctttagctgaaggagaccacccaaaaactagtggagagaatgtgaagcatcatcagcaccgagtatatagaaaatttggagctgtgaatcttgtgagagcgtttagtaaattggttatttgagtagaaaaaaatagtaatcagccttaccacccttccacaaaattcttcatactactctatggcaaagaaaaattgaagtttagaatttgattatagtttgatatcatactgaaaatgaaacccatatatatctaaagccaacaagcagttctgcagtgcatagagaaatcaatatccacagaggcaaaggatataaagacatgcttttaagtgcaactggttatgatagtaagcatgagcctagcatagaatatgtagtgaaaacatgatgagtaaaaaaaaaatccagcatctgaaaagatggccatacaattgaaacatgcaattagcatgctctaattgtttttaagcataaattgtaaatgttgaaaggcaacgagttaggaagcgtagttgaaatgcctgaaagtccttgatccctagcactaaatggatgataaagagaagtataattgatgttgcataagaatatcaaagtaggacaagttataatagattggtatgagtcactatacacaaaaaaagagcaacatgcatccacgtaactaaaatgatttacagcaacaagaataagatgaagtagtaattctaactttaagcatgccttggataagctaggccataagcatcagtgtccagtatatgtgctaaactagagcgtggatgagtcatgtgggaaaagaaaaaaatctccattgaagcatgatttgcaagccaatccgttgcttgattggcctctctataaatatgtgaaattttgacaatggaaagtaaactaatccatatttgaatgtcttaaaaccaaggagattgaggtaatttagaggcaactctattatttaaccaagagactataatagaagaatcaccttgcagccaaactctttggagatggaagaatgaaatgagagcctgtaaaccaagccaggcagctataagcttcacgtaaggtacagagcaagatagaaaaagtttgccccctagtctaagaagggctccatcatgatttcaaataatgaaactagcagcttctttatgcttctgaactataccattaaagtttttaccaacacccaaaaaggagggggcacccaataaataagattacgatacaagggttgctgagaattcagcatagggatatcgccagttctttgactgggcattagtgatagagtgacaatagaattgactttgcagaaggagatacatagctgcataacattatcttgagtagtatgaatattttggaagagatgcctattatggacatcccaaatgagagcagccatatagacaattactgctttcaatagcttctggacatgaggattagccaagaaatcaaatagagtagaaagggaggttagttgaaatgctataaaaaagcgagctaatgctgactagcactcttgggcataagtgtaggtgataatagaatgcttagagtcatcttgaacatcctgacacaagccacaagcaatgacagtatttggaacaacacctctagaagcttagagctgtttgcaaggcaagccatgcctttataatttctagcaaaaacatttgatccacatgggaactagaaggttgcagacggacataacattatgtggttgctaagtagtggtatcatattgaagagctgaggagatgtctctaagattgattttggaagatcgagagtgagctcaaccaagctgatcagaccaatctccctatgctaggggcaatgataagatagtagtcatcatcttagcattaaaaatccgatcaagagcagtcctatcccaagtatggtttgaagtaataaaccgaaccactgaataatgctagaggtcaactgtaacattagataaagagggccaatgtgataaaggaatgggcgccagacatggatcattccaaacataaatagattgcccatgagcaatgagccatataaattgatattgaattcttttccccataatgcatatcttatgttgaatgagagaacaacaaacatgcttctgatatgtctaccaaaagcctaaaaatttatatttggaagaaacaaattgagcccatgaagaatgaagttgaagaactaaattagcagcaagttttgaccgcaaaatttgttgaataagcttgagaaagcatagtccaaatccatctttagctttaggggtgcatatagtctccaagcaatgggatagaatcgatgctgatgggaagggaggcctcaaaaaaagatcttaaattcacattcgatagagttgagcactgtaagcggtattggcacagaaggcattgcatagagaggtataaaacaaagaacagattgtaagtgaattaatcgaccagcaaacaaaagaatacaccactttcatcctgcaagttttgcaaagattttttcaatgaggaaagtgaaatctacagcattgagcttagttctgaaaatagagacaccaagatacctccaaacacttgatttccaatgcatatgaaagatggaagagatgacatgtttgtcctcagaagtggtggatgggctatatataaagtaagatttggaatctgtttcctcccttatacaacattaacatccatttttctaagctatacatattttgattctattgactattgctacacatatcttcaatcttggtacactacatagaccttattgttggttttttcctattttactacatcagatgctatacttactgctaacctttaatttgtcctcatctcttcaaatgccgcaaatgacttagacttcaggtgccatcatgcttcaaactggaaggatcaagcacaatatgttctattttggatatgtgtaccactcttgcagctttgttagctgacatttcttggatatagtggcacactacttacttcaacatccccttctccttaccttcataacagcaattttgaggctttattttgcttacagttgattgattctcatgtgtgctttgtgcttcatcgcagcagttctatgttggctctttgatgagctataccacattacttactttcaaaactgggacaagattatctacatcactcttgagcatcaactagctactgccatgatgttaccttaccatgttgccttgatagccctcgctttagcaattttggatggcattttatgcaattgttgcgggtcactcagctatgaaaaatatgaggaagatatgatttctaagtatgcaggacaagagatccatttgaatcttatacaagtgtattactctaggctgtaattattacttctcttgggttgttgtattctttgcatgttaaggttgggccaccttagcaccttattgttttgtatcaacaaagctcaatctatgtcttttatgggctttggtctttacatttgttttgtacctcaagttatgcatattgcagtctcaacagcttttgtctctggggatatgtcaaggtgcatcatttgcttcttattggtcctcaatttggaagattatgccaattattttgaactactaaatatttacatacttcactgctgtcattaataaatacaagcttatgaatcatcaaggatatgtcaaggtgcatcatttgcttcttattggtcctcaatttggaagattatgtcaattatttcgaactactaatatttacatacttcactgttgtcattaataaatacaagcttatgaatcatcaactacctctttggtgttgctggactattgttcatatctcattatactgatgatctattggtttataggacttgttgtccttccatttgttactttggttggaccttcctcttatttgtttttaagtgcaacagattttagttctcatgctatgtaaataccttgttgtgttatactttactcagttttgttaatgcacagccactggctcctcagtttaccaaaaaaaataagatttagaatcattaacttgttgaccagaataataacaagaagcttccataatcaatttacataaagcatcttgggtagtagcctgagcaagaagaatacagtcatctacaaagagggcatgaaagattataggccctgtgccctgggtctataagctctaagtagcccaatatatagagttctttgcagtgaagaagagagcatctttgagcatgtagttatgcatatagttatatcttaattttataaaagctagtgctacatgattatgcataccacctgttgtggccaatctcctcgttgcctgatcaccgggaacgagcgtctgcaaaagaagtccgcactgaccggagtggctccggcggggaccctccgacggtcaagtcagagaggagactaggacaacagtagaaaagaatcaaggagctcagcgagtgagagagagagagctagagaggaagagttcaggggttgtgaaaagaacctttaccagcactgttgctttctccgttttatagtagggcgcggcatggcgccgtcattaatggcgcagacaatgggagaattgtcaaatcatcgaagactgtcagagtcatcgtagggctgtcaaatcgccgtggggctatcaaatcactagggttgacccgtgtcttaggtgggataatgctccagggcggctatgccacacgccgctgtcaggacggacagtcttcagtagtcgtacggcgtttgaaggaatcgaccgactgtatgtcggtgcctggttgaggaatgtcagacgaaaactcagggatcctccgatggtcagtcgggcatgttgcgagagtcggatatcgggctccacagttcggccagtcgggagcggaaagggtctgcccgactgacgtatactcggtcggtcggcgtcggcagtcgtcggtcggcagagtcgggcgctggtcaggcaggaccgacggtgagtcggcatgagggggaccaatcggtatatcccaacagttgcccccccactcctgagtcggatggtgtgctggccagtgcctttgcgtgggtggcggcgtcggacgaaaggagtgggtatccaccgtattgtatcccgactctgacgatcgtaccgttggctggtccagtgtcagatgtcttatgagtgtcaggcgactcatcggtatcagatgccccatcggtgtcaggcgtcccgtcggtgtcaggcgtcccatcggtgtcatgcgtcctatcggtgtcaggcatcccaccgagaatagaaatcaccgtttctgccgtctcttcgggaatgcgaaccgccacgactcttccgccacgtggcggggggccgttgggccgaacccgttcaggcggatagagtcgatgtggcctgatctaaggcaggtgcgtcgaactgtagggccgaaggaaggcccagatattgccacgcgtcacgatctgggagatcctcgctggtcgtgccttcatctcgaccgtcggagggcactatatatacagggtcacttgcttccggatttccactttccaaacttactgtcgagactctggttgagcggtcccttgcctcaggtaaccgtccccattgtcctttgttctcttcctcgcttcctcgtagtcctcctctttcttcctcttttattctttgacctctgttccggcgtaatggctagaatatctcctcgaggaagtcggtcggggaacccgactgacgattctcgatcgaccctggaggtggagatctcttcactttcggggccgaacgttgatcggctccgggagcagtactgcatcccagagcaatttcagctgttcgcccctggagccaatggtcgggttaacagcccgtctgagggccaggttgccttctacgtcgaggacctccgggccggtcttcgcttcccgattccggagttcgtctgaaacgtgctggactactacgggctatgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatacacacatagatacatatgtatatatgtatatatacatacatacatacacacacacacacatacatatgcacatacatatatatatgtatacatacatatacacatacatacatatgcacacacacacacacacacacatattttttttttcctttgtttgcaaattattgagaaaaagaaatgataaggtgaggggaattagaaattgggctaaagctcctccacggagatgggagatagagttctactttgaacctagggtactttaaatgtagattttgagatgtagtatgctagaatagagtgccatgctaaatgcttatctgaaaaaaaaaatttattagctgatgacaaccttatttgatcaaacatcttgttgagttctgtgaacagaaatcatttgcttagagaaaggggcatcattttctgctcaggtgtggcctatacataaggctagctaaggaacacatgattttgtatattctagtacaagaagactgagagcttcccagaaacataaaacaatagggaacctagaatttgagctcattcactttttgacatggttattttcttattaacctagccattttaaaacattttttttttagaattggaaaagaaaaactctcactttttctctggtgcaatattatagtgtacaaacatccattcttgactttctgccttatggtgagcctgatctattttgtgatgatgtggtactactcactttttaatacatctctattacattatgtgtatggatgagatgacggatggggataaggggtggtatgtggaatagaaattaattttcgcatatggttcaccatctcaatactggactctatattgatatcatcttattacaatgttggcacatggtatggtatgagatggcaaggtataccgagtgtcggtatagtacgagactgcgtattcatttagtaccaatatggtatcatatcaactggctcagcaaaccttatattcacatgtgctttttggatcagttctagctcccataagttttatcctcaaaactaggacttttggttaggataaaattctggccactccaaagtgttttttcaagttcgtagtgagattgtaggtcaaagaaaatgaacccgcttgttctagtcttaaaccttatcaggctaggcctaaggatgcttgggaagttatggacaatcttttaaactggcagatcttgcattgtaagtaacatcatttgggtacaattatatatatcatttgaacttagtttgcatccctctcttcagtcttcagggcatcatgttagttcgaaattgtaccttgtactatgccttaatgtcatttatttatcattttcagagaaacaaagctgcatgaacaagttgcggatctttctaatcttatttattcatattcgtaccttattactccactttttgtaagtatttgtttcacgaccaagaaagaaccatgaaattcaattttgttcaaaaatttactgcattgacatgtcctcttgataaactcttttagcttgaactttatttttctaactgacataatccttaaaaatcatggacaccaatgtaagaaaaaagataaagttgtactcaaagatttagaaaatctctttgatttgatatgagtagccacaatctctcaaaggccttctaggacaattacaacttggttgtgactagttttggtgccacagtgaacagaaagtagtaaatcagtgtggcttacaaggggcactaattttgatggcaaggttgtgatgaaattggtacgcagaagagaatcaaaaaggttcaaacaactgcaccatattgcttagggtgtgttcgatgttgtgttttctttataaaaagagccagaagctagattttctagcttccttgaaaagcgtgtttttttttttttttgactgttcttcttctagaagcacttttcatataatgttaccaagcacttttatttgggaagattttttttttggctttaaaagtcagaaaagcactttttaaaagcaataccaagcatgcccttaatgccatcagacaagaagagaacaaacaactagattttgtatgtaattcccagtttaaattcaacaatcctttttcttttgtgtgccccatagttggactgctagcggagccaccaaatggctactcagagtttctattaaagaaattactactacattaaaaatgtggaataacagtactattttttccttgccctccaacaaaattcatgcagctaaatagaacttaaaatatttttcaatcagcaatttgaatgagttcaaattcctattaagtccttttagattctgggaaatgattgcattggagaacataaaaattttacccctaatgtccacaaatagttacaaatgagattggtccttcatgttggtaacatttcattaatgctatggatgatggatgtgttggattggaatagtagagacattaactaacgggtggaaagggggccaaattgaaggtttctaagggagtcgacaagactatattgaagatacaagataatttgactgaaacaattcatcaatgcatgtgatgtttaaatggttcaaggaagaatgagaagattgacttatcagcgcatggccccatcagtttagactgttttctatagcggaacctgtttcgctggggaagaagcatggatgattttggcgataacgatggcaaggatgataagatgatggtagctagatttcattttcaaataaaatagctcattatgtcttgacacactcacatcgtcagctgttgtgggaaaatctgctactatactgtcttgtgattgtactttaatcataattgaatgcacatgtcgtgctagcaagtttcatgttctgttgccttttgtgtagagtatgcataattcaatgtcgttatatataatttatttagttttctttgagcatgttcggttttctttctatttgggaaattcaactactgatcccaccacatcttgtacttttactagctctactgttttcaacttaaatgcaagtagagaaatgtattcgttgattctattttcactttttagactcatgatagtaggctctataattctacatagcttattaaaggagtactttaattactggtgcttgaatgtatacaagatttttttaagttttgatgctttatttaattcttatccataagatttggttggtttattcaataattagaatgtatgggccccatttgcatttgtacatgcattatgtaattgctccatgcatgtatggatggatgtttgtgttgtattctgtcctaaagttctttctatagccttttttgttatatcgattcttctcctcctcatctctactttctttttttaattaaaacctcaaacttttctgatataattgttccactgaatgtaagcagacctatttagtttaactggtgtggtcaaaattttacatgttaatacagatgaatgattccccactggggaacacatgattgagtgttcatgttgcccttgtgttataacactgcaaaagtttttgtcgtcaagctcgtatggagaattagatgcattcagcaaacaaatataaactcaaatatgcacatgtgaatgacatagcttgatttatagcatcaaatattgtataaaattgaacattgattattatgatgttttattctcctcttgtacaagtgctggatatgttgcgataaacactgtgcgtgttatcatcgttattgcactatctggcactttcatatttcatcacttcagttactgttcatacatctcttgcacaaatgccttgcacctgaaagaaaaaagatagttaatcttaccaatattatctgcagttcccttagtatgtatttacggctgatggtcacaatcattagcattgagtatgttatctgtaggtgagatagtatcagtatcagtttcagtttcatggttttgttgttttggtcaaataaattaagaacatcctaaaaataaaaaatagaagagaaacaaaggaaaccaggaaaagttactacagttcagaataatattgtcttgtatagtttctttatacgtgtaattttgtcaatttgatcttggaattaatatttcatgtgagtgaaattcatgagacatgttagtattttgtatttatagacatataatttacttcttcaactttaattgttcaaaaattcaccatattggcaattgtgaagcttttttctacctagtgcaaatattttcttgattttctaatataattcacaaatatattgaattcaggcacttcgtcataatatccttattttgaagttaagtggctatataatcaagtgcatgtagttataaaaatttataattattttacataaagcaggatgtcattttgtgaaatggattgatttagtttttcacattagtctttatagagtactataataagggcttctccaaagatctttgcctatcaagatttatttctattagcagaaaaagaaaaaaaatcatcaaaaaatgatattatatagcctatgtactgaagtaaataaagtaacaacctcaatatgacatagatactggaataaagcttaaaaaaagcatatatatttatttttgggtaatttatggcccaaactggctgaaatcaccaaaactaaatggaaactagttagtttggctgtaattgactgaaacttgaatccagggtcagttttggttcagtctttacccttgaccaaaaccaatcagcttcagctgaacattaaaaccccagatgatattgcttagtgagacaaggatgtgattgaaatgctaaactagaattaaaattgaagctttagaaggcgaaggtttgaaaagtaatataataattgaaagtatattgaaaattttcaatgaaaataaatatggaaagcatagccataatcaccatagatggttgggagatattattctagaaacagtttctatcctgtatcagatctgctttgaagagaaatagaaggatcaatgaagtcagttataacagaattcatgttggatgataagcggagaattcctgcattaggcatgcctctcaggcttaaggaaatagtttaatactacaatgaggttcgcaatgttgtattgtcaaaatgttggttgataaaaagagtttgagcacacaagataagcatgacaaagatgggaatattgacatgagtatgcaattaaatgaaaaactatatgcagaaaatgaatacattaaggctatctttgttttcatgaaataagtcccgaataagggctgaattaggggcttattcatccaaacactgaacatttattcacctctaaccagcataaccttattttagtcaactggtacataaccatgttaacctgcagaaatatatttggttgggggtgttgaataactttactctgcttttgaaatagctttaattcatctcgaattctgaaaggtcagcagttattaatttatttcatgttatccaaccaaacaacatttgtggcagtttgcttagagtccaaatagaattacaaaaaatttactcgtataaattccgatgaagttgaatatggaggaatacaaagaaataaaacaacttattcagattttccttattcgtgagccaatcacagcctaaggctgcatttgatagcaagatagaaatccaaggaaaagtgtctctaacctttgtcatccttccaagattcctttatccctggattaaggaaaagttgcttttcagttgggaattgttatgggtaactgaaaatgttggaaaaagtggagaaaaaagtaagagagagaagaagtggaaacaaaacaggtcctataggtggtgtaagagctgcacatcaaggactaactggtgggaaactgttcgagatggtatacgcatgtcatgtaaaaatggtgatacatttcatttaaaagatgttttacagcgtggtgctacaattttgattcatatgttttatatgtgatcttttgaaactgataagcttggaaaattatgttctggtttttataccttttcattccatggatgtatattaaaaatttgatatttaccttttttttttttttaaactagctgaagattaatttgatgtgatggattctgaaagcaagaagtttggaagaggtaaccatttcaggaaaaaaaaattgttgttttataatacatagacgtaacatggctatttttgttaacctcttctttttgtacttatataaattagcttgatgctcaagactaaatcctaatttactaccagtctgctagaaatattttgtgaaaataacccggcatagcttaacttgggggcgcagaattgaaacctacacagtaaaggttgctatcgttattagttagtcagccataacatacttggacatattagtgctatttcaccatgttatatgtttcgacagccctcggatccccatttgctgtttgctatcaaacttcagggttagatgaagattttgtgatggctgactcatgccttgactttaagatgctagtaattaggcagccagagaagaaaagattatgttgaacttgctcaaaatatgagatgaaaagaagggagaaaacctgtccggtatttcatttgttagtggtttattcttgatagaaacatcgggatcctcaatattggatgcgttatgttatgaatgttccggttggatttttagcctccaaattgagtttgtgctgtgcaagttctaaaggacttctctttcaggacctcgggaacttactggtgctgttgatctgatcaatcattacaagttgtgggcacaccatgattttttttgcaaaaggactctgcctctgtcaatttcagacacacactatcttcacaatgtggtgggtgacacagaaatccgaaagggagaagggatggagcttgaccagctgtttcagagtgctccatacttgagagagacaactgctaacatacggccctttgacttggacatccttgggcaagcatttcagctgcgagaaacagctccaattgatttaccctctgtaagaagcatttcattgcaatgggtttttgtagtttttccttttactagattttatgaaaggtcttatgtgacatcatacaggcagaaaaaggaatacctacaatttattcaaaatcaaaaagcgagtccaaggacaaggacaggaagcataaaaagcacaaggacaaagataaggacaaagacaaggagcataagaagcacaaacaccgtcacaaagatcgaagtaaagataaagagaaaaagaaggataaaactggacatcatgattctggtggtgatcactcaaagaaacatcatgagaaggtcatcgttttgcctggaatttctttattccaacatggctgacttttattcatcatgttttctaatttctttctttctttgtgctttttttttcctggatttcagaagaggaagcatgatggtaatgaagatctttcagatgttcacaagcacaagaaaagtaaggtagctgcggttaaagtttatttggcatttttcagttccgatgaattgcaattggcaatatatgtttttccccaacaataaagcaattctgattgttatatctttcagcataagagttcaaaggttgatgaagtgggaggataaaggatgcaggcgtaaaatctgcttgttcacatattacaaacatgccattattgattatttttttgaaggattttcttgcacgagcaccaaaattttgtgaggtatttatgccctctttttccttgccattatcagctatcttactttttatgttttttttcaacattgagtgaaattgcatatatgcagtcttataatcatatctaatgttggatatactgcccactttcttgttgttctaatatgatgcgatgcacaaactttctgaaatgatggtgtactgtttcaacaaacctggtaaaaattataagcagccaagtaaccaaccttagcagttatatgggccttgtggacggaaacaggagggcctggttggttgggcgagggagggggcaccttacctttggactaatatttagtgaaagaagtccctcccttgtcatatgagttttgtcttccgctccactctttttatgtgaactttgagcaaactataacattaaatgaatattctcataaatcactttccatataaattatctgattaccatagtaaattagtatctatatgtaatgtcattttattggatcaaaaaaagagtaaagtttttttagtacactaatgaacgtaaaaaaaaaggggtagaagtaaatgaagagcaaaagaagtaaacagacctttttccccttctttcatattaaaaagtaagtttttttatatgtttgttttctatcagagactcattatagcttttctttaaaatttcaaattgatttttcatccaagtgccttattgttatataagtaaatttatattcttttcaaatttttctaaatcgctatatatacattgtctggccattagatctttaattttaaatccatcaaataaaaaaagataaaaggtaaaatagtccattcacttgatctttctattagttgtgcgatattgatattctggaatttttaatatatgttatgcagaaaaaatagactaaagagaaatctatctaacaaaaagaaatgcaattcataatctgtaaatcatgaacccttatttgtttatattaataagtaagtctaatttttactcgatcatttgagggatggattgattggacaatgtacaacgatgtaagcctagcaattacttataatttgtttaggaaagaatttagataaaattttaatgaaaataagtacttttagtataatttcatcaaaataaatacaatatttaagtaaatagatgttgtctttggaagtatgtattattggccaccccaaggggagatttctggttccatgctgatgggcctgtaactgtatatcatgtgttaacacagccagctgcatatgtaggtttctttttgatacaagtgtgtgatcacaccactctggtgtgagtacgtaggttcttcttcattcctttgttgcattagataaaaagcaatgtgtatagaatcccctagcaattgtgagtgtacacaactaatgttaaagaccatctccaaaatgctaccagttgtcgaactttaaaacctggagacatggatgttcttatctgaaataaattaaccgttggttggatttacgctaccattgcttatgaaaattctcatctcccttttcttgtcctttgttgactccatcatatgctggctatgtaatccacctcagcatattgcatatgcagtcttttggttgtaaataatgaccgagataccattttggtttctcaatgcaatgattggatccaaaaatgaagcttacaagtgaggaagtatctgttgtataatcacagataaaatttataagcagcaaatgctactagcctgccactgtggatcatgggatcaacattgccaatttcatatgctgatgatgggcatgatgtttggtggaattttgaataagatttgttggataaatacccttttatttcctattatttagatttaagctctttgccaagtcccggtgttgttgcttcattttgtttctttgtgtctgaggattagatattaaacaaatatctctttgcatgattagctagcaatctttagcatacacaagttatcaagctttaactattagtgtcctatttgaagtaatttatgatatccaattgttggttgggtggttaagaatggctttgtattatttatgtatggctcgtgaaatttgtgcatcctctgctagctttaagatgcgcctttattatcttcttctgcacctcatctctgaattcgtgattttctctggaagacagctcttcgctttcattctgctcgcagaccctttgtttttaaaaggggaatactctgtagttgcactgcaacaatgcattctcatctgacatcgatccatgttttttgagtaatgcaggcttaggaagattgggacacctttttaatcaaggtgggagtggaaacgctcgtagccaagcacttgcactgataatatcagacctgcctaacagtggtctctagccactcctctctgttaacaaaacggactgttaactaactgcagtgcagtgctgtgcagctctttctgtctcctaatcactaacatatggtgccggggcagttagagcctacttgtaaggaacattaactcgtctgatccattagtcagcactttgaaatttaattattgagttgagttccgctggtatatgctccttaataaaatatggtcatgaaagcaggtttaccagttcagcggcttttaaacagtttgcagttgtggttcttgttttttaaatgccgcgcacatgatggaagaagctctttagcacattgtattgggcatcatagcttgtgtattttagaagcgcaaactgtggatgccagagagaaatattagttaaggccaaacattgctgcccccgttaatctatcggtggatctcaagtgatttgccttaagataatttttcatcaggttaatatgaatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattaattcatatacaattacatcaaatagcacaaccatcaatagactgataattgatattgggatatatttttctataattttcatttgtactaaagtcaatcggtatagtattgtatacccatcttcattttgtgatcttcgaactcctttaccagaagagctttagtaaatggatcagctaagttctcctttatgtcgatcttttgaagatcgacgtcatctcgatccataatttttcagaccagatggtagcgatgcaaaatatacttcatccgctgatgtgtcttcgactcctttgcctgagctatggctccagtactaacgtaataaagcagaactgaaccatcgatggagggtgtcactccaagctcggtgatgaactttcttaaccacacagcttcttttgcagcattggatgccgcgatgtattccgcctcacatactgaatcaactacggtatgctgcttgaaacattttcagtagacaaccccaccatgtagggtaaagatgtattccgacatatttttgctatcatcacgatctgactgaaaattgaaatcagtgtatcccacgagtttcaagttagatttttcataaacgagccactagtccttagtatttctcaaatacttaaggatgattttcgcaaccttccaatagttctcacccagatctgattggtatctgttcactactcctagtgagtatgccacatccgatctcgtacatgtcatgacttatattatagaacccactgtcgagatatatgagattctactcatatgttctctctcttgaggaattgtcggacaatccttcttcgagagagaaattttatgacctatcgaaaaatagcctttcttgaaatttttcatgctgaaccgtttcagcatggtatctatgtacgttgattgagaaagttcgagcagcctcttagatctatccctatagatcttcatccctatgatataggctgcttctcccagatccttcatggagaactgtaacgataaccatacttttattctctataatgcagggacatcatttttgattaagagaatatcatccacatacaaaataaaaaatataattattgaaccattagcccacttatatatacagagttcctctccgttctcaataaagccatacattctgatcatcttatcaaaacatatatttcaactttgagatgcttgctttaatccataaatggatctctgaagcttgcacacgttagactcgtctgtggatgtgaacccttcaggttgtatcatatacacctcttcgtttagctctccatttagaaaagctatcttcacatccatttgccaaacttcatagtccagatatgtcgctatcgcaagcataatccgaatggacttgagcattgccacaaaagagaacgtatcatcatagtcaacatcataacgctgataatatttttgacaaccaaacgagctttataggtctctacctttccatctgcgtctttttttcttttgatgacccacttacaccctatgggttttatcccttcaggtggatcaaccaatgtccacacattattgatcttcatggatttcatttcgaatttcatggcttctgatcatttctcagagtcggacatctacatcgcatccatataggtgattggatcctcgttttctcatcgagctcaataggatctccatctcggatcaaaaaatctaagtatctgtctggctgacgtggtactctactggatcatcttaaagatgtttgtatattgggcttcgaatttgatcttatcaaatccggttcagattcagtcactggtatcagttcttctacctgtcaaacttcatcaagctcgactttagaggtatttattccttcactaaggaactcctttttcaaaaagtatgccttactactaacaaatatcttttgttcagcagggaggtaaaagtaatatctcctcatttttttgggataccttacaaaattatatttatcagacctagatccgagcttgggcctcacaaagaatgattggagaactcattggtcccaccctccttctagatcttgaaacttggtcctaaacgaaaaatagctcaagaagaaaggctagctgaaaggtcactaatcctaatttgtaatcgtttgacataagttggacaccctagaccttaagataagtgaggttcaaccttacgttttgatcatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagactgtgggtaggagttcagtatttaaaaataattttaaattttataaaatatttttattattaattttcatgcataattacttagatctgaaacttgaatcggctcacccttggattgagccgactcatcacaatgggtcgactaagttttgatacttagttgactcattgatgataaattattaatcataatttttggtctgttttattgagtcaactcaacagaaattgagctgactaaccaagatcctgagtcgacccaaacaatactgagtcaactcaacagacagattacaataattatattaattttagatcaaaataattttatataaatagtaataaaatcaatcataaattattttagaactattctaaacatatttatgattctaaattttatttgcaaaaattagatgtaaatacttttcatacaatgtatcatatacacaatcttaaaattttacagaaaagtaaaattttttttcgtattcatcttcatgggatatagtcataataacactcctacacatcgtaagaggatctaattgaatagaaaaaagaaatatctaatctttattacctcctatgactgaacggcctagtgacaaatccaatccgattacttcgctactcagatcatctaatctaaataacttagatctaatctaaattatttcagatctgattattatattttgatcatatcaaaattagataataatcatcataaataaattttatatacttcaatttaaaatcagattttataaagatcagcacaaactaagacaatctttacagtataaggggtaaaccttacagcaggataaccttatatcagtttgtgcgatcagatctataactaattttaaatttaaatatcatatatcagatctaatttaaattaaattatagatttaaatatatataatatcatatcatatcgaatcatggctctgataccactgttgtgatgcataggggtttcatgcatgcatttcaaaaaaaattttgcagtgaaaaatattagattaaactatttaatctataaatatattcataagatctgattttaaaactcctataaatagatctatgatatgaatttatatgcataaaaatttgaatttaaaataacaagtatgtgaatcaaaaatcagtatttagtaataaatctaatctactactatcaaggtttcagacccaatacttgagcatggatagccaaactctatgattgagaatgtgaatctaaaagttttctctaatcgctcacagtcgcacaagcatccaatctctacggatggtctacaaaaagccctcagaccaatcagccctccgtgggagtgctagctcgcgcagtcgatttctgatggtagatctgattggatctccttcttcgatcaccttggatcttttcgatgtcaaagatgaagtagaagagaatgctggatagtggaggaaaaatagatgaagacactcttctctttgattttttttcatccagaaatcttagaacagttctaggtctctcatacgagaaaagatcggtctcatcctttattcatgccaaagaagatagaagcccatccaaacctcatgccccaaaaaaggtatttggcccctctttctctctgatatcttatggtaaaaatcaaagagtggttggtgcataaaaatatgagctttttatggttgtcgcacaaatcaggttagataggataagaactagagtttgttgcaattcaaatcattttgaatttcaatttaactctaacttttttttacccttatctaacttaaacagagacctaccagagaattttaggcatgaaaaacaatcaggaacacttccttttgatcgcacataataggcgccttcataaggagttaacatgtggaaggatagggatagggttttaggtttaaatttaaatctttttaaattcaatttaaaacccaccaaatcttatccctaatgtgcgataaaacaagagttttagcatagatttttcagtgcacaaaccaatttgtgtgatgaaagaaggtgcaagggagagaagggaaggtgcaagggagagagttctattcattttggactctaagatttaaccaattgtgtttctatcaaacccaatccaattaaatttaataaaatatgatgaatctaatctaattagattttcataatctcaattaaacttgatcaaatcagtgaactaattgagccatagatccgatcaaatcaggatcatttctctcttatcgattaggtcatctcacaacctaatcaggcctgatctgattgaatccaattcaatcagacttgatgcagactttaatactcaatcaaattaagctaattagtattctaatcactaattaatcctttattaataataaaatcccagtctagtgggctcttcaccagagtctccgtccagtgggactcttcagcagagtctccatccagtggaactcttcagattagccatttgatcggagagaaacttctaatatgtgtgatcccataggttcaaacttaaatcggtagtataagaatagatttttgtatcaatcaaaataaccatctagtaatagtacctaatgtctggatagattaaatgtatgcaaagtaacactcaagaacctacttggatatagttaccgtataattcatccctttgacccttgatgctaggatgacttagagtttaaactgttaattattaacaatacatccattatgtgtctcaacctaataaatcatgtgactcctcacaaggactgtcctggtcaaggtcttactaaatttaaatagaaagtattctttccaatcttttggtgtggtcaattttatcttgactcattcactgacttcaccagtacttaacactatccaaacatctttcaatcctgaattagaaattcaagtagtccgacatcaaagtacaatgagttgcttgcaagtcatcatgaagatctcagatcggagagacacttatacccatatcttatcggagtgactcttgacagcaaagtactccaaagttgatcatatttagtaaaatatacttttatatttcacctgcataccataccagcatctctatgctctttggttaagaagacaatcaatctttatggcacacaatgacttacacttgatatgtctatcgtcctagtaatagcatatcatttgatcgcgaacttatttaaggactaaatgataaatcctcctttatagatttaaaatagtcctaagaacttttatcgtaacataaaagtttgatatagaagatatacaagcttatgatgaaaaattatcaaataaatatttttattaataattaattcatatacaattacatcaaatagcacaactatcaacaaactgatgattgactttaggacatattttctaataggagacagttcgatctgagaagcttgagatacgattccatggaggctgaccagtgtgggaggatggggctataaatacacccctctcagtattgtgcagtaggatttggtggaagagacggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaccctaaaagtaatatgaaagaaatttaactattgaacctttttaattatttaattgattatactactatatcacattttaaggacaggtagaaatagaaaaaactatataccgcacatatcgaaatagttacacgctaggttatattactaaactgatgcattttttcaacaattagactcccaaaaaatctgtatattaaaataaataaaaaaataataacagccatccaagcgcatcgcatgcttcaagatctagttttgaattcataaacaggcgagttcaacgcgtgtccaaaatactgagaaccaggaatttgaaaggaaaggtcggtgcccttcagcatggaacactcgtcaagggatgacaccatccgaattaaggcacggggtattcactgcttgctgttccatgcaccccttcgcccccagccaacgagtccaagaaaactgattcgctacttcctttgaccaccaagcttccggaaaggagcaaaagttcgtgaatgtggttacaatatgcgtttggccagccggacaatcacaaacagcgcctgcatggttatttcctgacttaaaaataagatgaaacaataatgcctgtactcttcgttcgacaagtagccacaatagcaccggtgttccattacttaccagagtgacaaaatctagacaagacattgaatttgtgatcagttctaaaattccatcagcttatgagttcaacatttttggtcctcgttcgttagcaaccggcaattgttgaattataaccatagataggcaagtacttggtggttatacattgaacatcttgctggatatctgcatccattgaattgcggtctcgtgataagattccttcactggcgcagtcaacaagtgtgacaatttttaaggtgcagtaacaacggtgtagagatttacactggtataaaacacacaaccattttaacatcagacaagcagtaaatctcaggcttgatggccatccaaagtttgaagcgattccttgagcagcctccgagcctcctctctcctcctgaataaaatagacgttcaagttgtgaaagcagttagcatcttgcgagaaacaatatggagcggttacagatgcagttagtattttcacagtttaaacataacagaaatgatagctaaaaaggatttacaaagtcaaacctcaaataacttaaagcattaccctgtaatttttgcttgcatgagaaatgatataaagcatcacaaatctgtaattcgataagcattgtgtccatctcacgaagtaacaggtataccaacacttctatcattgtggctgtggttatatccaagttccataaattcaaatatttgtcagaaacactcctgatgtatttatgttcttattagaaaaaaattcttaagctgatgagttgcctaatttttgggtgatgatatcctttctaaatcttgtgtttgtaaatggtgagacaattattcctcataaaggaacgaggatctcagttttatacttccatacaactaagaaaagctattttatttctactagttgctgcaatcaactggttgactggaagttgctggaaatgggaaaaaaatgctgtgattagagtgcaatctgaaagatgaaggagaacccaagaattttacatgaaacatggaaattctataatgactgtatgtctgtatcaaatcatccatgcgactatggatctgaacaagaaaatgtcgatatttgaacagtaaaaagatttgagtactaacctttttatatcctctattgcttgtttgcgtcgttgtatctgacattctagaatgtgaatgagtgttgctctggcctaaaggtggaaaaataaaattacagtgccaggaacaagaaaatccatttcagtacataatttttagaataaaagtgaacaattaaattgtgtacttgatgaggacgcaaagaattgaggagatggtgcaagttcttgaaaataagagatatgtcttccactctacgtgcatattgggaaggtctctccaccagaacatctgctagctccaagatatgcagttgaagctctctattgagcgattgtaattcctttttaaaatctgaatgaaaaacgaaaatcttagaaataaatccaaatccataaaccacaacaatgtaaaggcagtagatgagatggtagtctggatctgacaatataattataaattggataatgacgtgtgccatagcttacacaaaaaggacttacaaacaaaagaaagcactttgaggttatagtggcatcactctttagagaaccctatagaagacagaaatctgacaagggaaacaaaaacagatataacacaagaatgcagcttggtaacttgatctgctgcataagcataaccatcaaatcatgttccaactattctggctttgttcgcctttgtttggttgttctccgattacttgcattaaggagattttaagagtctcaaagattaaaaaaagggagcgaaaaaaaatgaaaccaaactaaaatcacattcacattgtatgttcaatcatcagattttgttgccactctttattcttcccatccaataatataggaaaggaataaattacagcaacaccccttcaaccttccacgattttgcacttacaccccaaaaattctaattttttcaattagacactaaaattcaggtttttgttgtaatatggcccagccatctagtagaggtctaacatcgttaacggtgactatcaaattactaatttaccctttcatttttaatcagaaaaaccattcgaaaattatagagacatcccttaaaaaaatcatgattttcatgtgcaccccaaaactttcaaaaggttacaccgggtcccttgactgatatatctacaactatttatggggtgaaacccatcatattaaccatcttatcctttccagcactccatttcagtgccaacaaaccttttgaccatattcaagagatttgcaagagatcttgcttggaaaaaatgcccttttttcctaaaggtaagggagggtgaaagagagcagccacccatcatttattagaaatcagaagaatcaggggatatgtacagcggtctcaaagatcaaataattacagacagcagagggaaaaattgggtaaaaataaagtagaaagagctgatataacaaggcacatttatagatgtttggcactatactaatatcgcagaggcatcttaagcagagggttctaaaaattggcttctccagagccttcaatcagtgatggagctatagttctgagattggaacaaggagagggctaaaacatcagggcagtcagagctttgcatcactggtctttgagtacccataagccaaaattaatctaaaatctataaggaatatatatttgtggatgactagtaattaaacttaaggaacaccacaaaataattaagccatgagtaattcaaatcatcaaactgcagaaccatcttctgctcatcaatcaactatcctttgaaaatttcatctaacaatactacagctataatgtgcaaagagatataaataaatcaaaacaaagaagggacaaatatgaattttgatgctgaggttgaataaccaccatttagagtttaaaaaaaagaaagaaatgagaagagatgagatgagaagacaacaacaattatcacagtacatacatgtttcatgtatccccaacacttctcctagcccatggaaatcccatccaaagaggaagcatctaaggagattgggagatttccctccttgttagactactgccatatctttgacaccaaaaagctttcacctttggtagcataccaagtttcttcccctccaaaacctcattacttgttgaattccaccaactctccttcccctgaccctcttatcaattccaatcctactagagccaatgcaaagagacacttggagatttgtttccctaagaacatactgataagagcacgtgaagcagcatctccttgcatccaaagtattgctgctactctcccattcgtctcttcttatactacctctaacattgccattaccatcaacattatcaccaccagcaccaccatctctattgcccaagttcttgaatttctcaaacctcactgcgaacactctcatctcagaagcaatctcctccacttccaccagcttaccactgctagatatttgacaccaaaaagctttcacctttggtagcataccaagcctcctcccctccaaaacctcattacttgttgaatttccaccaactctcctccccttgaccctcttatcatttccaatcctactaaagccaatgcaaagagacacttggagatttgtttccccaaggacatactgataagagcacataaactagcatccccttgcatccaaactactgctgctactcttcccttcctctcttcttatactacctctaacactgccattaccatcaaacattatcaccaccagcaacaccatctctattgcccaagttcttgaatttctcaaacctcactaggaacgctctcatctcagaagcaatctcctctacttccaccggcttctaacctccaggcacagttgcaaaaatgggaaggagttgacgcgagctttggtcagaagttttgggccaacttcatacttaaagccatggaaatcaccaggttcctctcttctccctccgctctctgctcctctcttctcccttcactttctcagcaatctcttcttccttcgctctctcctcctctgtctcttaagtgaactaaaattggattttttgaggcccaatttactaacaaaggaagaggaatggaaggggtcgcatgattgctacgtgatctcccatttccgccaaaacacatcacaatactataatgtagccaacaaatatctggtatttcctctcttaagtcatattacatgactgtcatgttttcctgaatcccgacgaagatggacagctgggccacattacaacaaaaacctaactcttgaggtctaattgaaaaaaattaaaacatttggggggtaagtgcaaatcgtgaaaacttgaagggatgtcattgtaatttactctacaggaaataaagttccacttttttcttctctttatcattactaatagcagtacaaaaaaagcaaccaatattctatattccaaacgtcatatgttccacacaaatcatgttaagaacgaaagaataatggctgccaatttcaaataatataggtaattggcatggttgccagttttcagatttcaatgttttaaaaactgaaactagtttctatttttcaaaaacctcaaatttgaaacttgtttggcggcaaatatagtgatattggtggaaacagtggtgatggtggttggcagtggcagtggccagcaagcagggagtggaggctggcaatggttgttggtgacaatggttgttggtgacaagtggtaggtggaaatagctggtggcaattggcggtggcagctagcagcaagtggtggctagtagtggtggcggtggccggtggttgtggtggccagtggtggtcggtgattaccggttttcaaaaaagtcaaaatcacattttctagtttacacaatttccagaaactagttgctagtttcaaagaacagaaaataaaaacagggttctgccttgatttctgtatttgttctaccttgatttgtatttcatgccaaacaaagccagagcttctccactaatcatcattgagccccacatctccccccaaaataaatttattaccaattaagatatgggcaaaaatggctgtctaaattatattctgaagttttggaagatttaagtttcacattgtgttcttccaaatatagtgcaacccatcactgggttgccacttttgttgcagagcactcataagggattctgtggaccgatgcggcagttgttccagtgtctttccataatattttattttctaactctcttagttgtattcatactagaggttaatgaatgctgtgtcttatttaaaaaaaagggggggcccatacagtgcgactcacctattggaaggacctaacagagttcagcccatttatctttcacctactcacaggtgacttggaaacttcatcaagagaaagtgccacctctttaatttcttccttatttgacttcattgtaaagaaacactacctcactgatgtaacccccattgatgcaagggattacttatccaggtctgaattttgatctgaatactgtgcagctctggacccttctttctgttgcacaaacttaacagcatcagacctgattatcagcaagaaaactgctttttaacagcagtttttagcacaggaatgagataaattaggtttgaaaagagcagaagagggagtaaatcatagtagaaaagataaacaagaaaaaaggatcactgaaaaggggtcctgcagccttttgattactagctctcacagaaatttttcaatcaccagtccatcttacaactgtaaacatatacctttataaagcatcagcatatcacctttcctgacacctccaatgactcttttagaaggaaataaactaaaattctaaacaaccaactcaatcagtggaccgcattcaactcctactaggactcctaatttaagaaacaaaccagagattaaatactagattgagatgactagctgacattttcccaagaactaataggaatcttaacagggacactaaatactaaacctgatttctgactgaaatactccacaatgatattaatcagacaccttttcttgacttaaacacatgctaaagaaatatatgaaaattgtaagaacatagagatataagtctcaaagactgaagaaatttaacaatctgattcttcaaattcccattcacattaatacggcatcctccttttatatccaaattttttaacctttgcattggcttcaaaggtcgtatcatttccatacaatatggagagcctatgagaaagaaagcactgagcacttcaattcaacgtttgccgaaccatctcgaaccggatagttcaggacatttcgagccgtatcaatgacaaaccgtgacggtttgaccaggcaaatcagaacattggaggaaggagagaagaagagaagaagagagagagaggaggggaggaaaagagcggatgacgccatcggaggctggcgatggcccatcgaggctgccgaagggccaaggaggcctccgcagctcggcgtcatctaattctatagctcagcatcgtccgataaggtatttaattgagagagaaagagagagagggagggagaagcgctagtatcgatggagaaataactacggagaggccgtcagagagcgtcaagtgaccatcgtggccatcggacagtgaaaaatatgcaggcggagatgctgccgccgcggaacaggggcgaccgtccctgtttagttcatcgtatttttttaaaaatgacgataaatgataaagccagcaataggtttgtcgccttcactgtgatcgtgatttttttaaaaaaatcatatgaaacaggggcaatcgcccctgtttcacgtccgtagcgccacaagccgtgattgcaccgtctgacggcctctccgacagcttctcccttcttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatattaaaaatatttcaagaatcttatatggtatttatattcaagattagacataaagaacataattcagtatgctagcccaaaaaatatactaatttatgtcaaaataaataaaaatataatataacaaactccataacgatacaccctcctctttttttgggggatgagcgcggagggagctaccatataagaagaggatagcattgaaggcctcatggatgggattgaaagaggaggacgagaaggaaaagggggtaaaaggagagagaaaaaggggtctccgggaaaaaaagcaaaaggtggagggagccgctgtagaggggaagcgctcatacgtaaggatggcaatcgaatcagatcgatcatatatgggtcggatcagatgcaagtcggatcaaaaaattctaaatttaaactcaatctgtttattaaacaagttagaatttacaatataaacctatcatatttaataaacagataatctaactcgatctgtttaacatatttattaaatgaataatctattaacccaatctaatccaacatatttaatctgtttaataaatgaataatttgttggtccaatccaacttgattggtttaaaaatagaacttgttagcccaacatatttaatacatcaagtagcaaaaaaaatatgaatctaaaaatagaaaacattgcaataaatttttctaaatagcattttcatttaatcttttttttggaagctataatttacattcaatatttacaagaagataaatattgaaaaaatttcaagaatcttatatagcatttatattcaatattagacatatggaacaaaattcagcatgctagcccaaaaagcatactaatttatgtcaaaataaattaaaatataatacaacaaactccataataacatgccaacatatttggcaacatacaaaatttgaaaagtcaaaccacagccatgtgagcatttcttgatcctaaaacaaagtgttattaaagagtccgtatcccaccagcttattttatgtagatggctgaaataaaacaatattctataaattatcaattgtgcttatcccataaaacaacattccacaagattagagttattgttcattgtgtagttgaatacttaatggaagttttaccatgacttaccataataaaaaattatcaagttaaaaatagttaaagaaaaaatatatttcattacttgcaatagtctagcttacctgtaagcagccatacatctggattgttatatgtggtgaaaagaacaaacatttgatataatgtagaaccatagaaataaaacatggtccttccttgtcttcaaatgtcacatatgctaaccaattagagaataaaaagaatagtagccaaagagcctgaacttataaaaataagccaagcacctagaaaataagaaaaacttgtgataatttctagatcatactaaacgagaatatgatagaattcatggcaagcaagtaaagaataattgtatacattttgagagataaaacaaggaaatatgaaactaaaaacttaccaatacataattataattgtgttctgatctgtcaattacatatatagctaaatcaaaatagctacgatcggttgcctgcagaagcaggccatcaaaggttgcttactattagaaatagttgattcttcatgaatcagcaaaaatttattgaagaatcatcttagcctattcatataaacaagtaagaaaataaattaaacatataaatcatgaatagaaaacaaacaatcaaaattttagaataattttacagcaataatttatacaaatatcaaaattttacaaaaacataatttaagtataatagatttcattgaaaacacttacataaacatatctatttctgaatttgagtaaagattaagaaaagttcatcactttcatcaagtaaatgaaaggagaagtacaaaagatggagggagagagaagacataagaaaaggtattttataacagcaaagttagcaattgtactaaaaaaaaataaggaatccctactttataacatagtaataaactaagtaaattttaaaaatatcaaattaaactatttaagtaaacacctccagcatatgcatcagcatatctaagtgtgcattagaataattatagccccaatccccataaagcagtccatattttgtaccaattactcaacaaatttcaaatcctctcttattaaggcatgagaaagaacattgatctaatccattctcgattgcaaagaggaaattttaaaaatagatgcaacttagttaactaagttcctatttggtattaattaatggtctgtctatcgggtatcttatttctatttgatgcattaagtcacacgcacatatgggccaccacgattaaatcaatcgtaccaaaagaaatcatatacacttagtaggaaaatatttggagttgcaaaacttctaaaaataccaaacttacctacaacatctcctagatgcccaacatttaccttggagtgatgaggtttcacatccttgtgtgatataacaattaaaccaaaactctcttcgaatgtaagagactgaaagtaatacaataaccttctatagtaaagctagtcatctgatgtttcatagaacttaatataactctagactttctaattgtatcaaggatcgagtcacaatgaaactactgaaaaactatagatgcaaacaacacatacttctgaaccatttttttcatgcagatttctttaatattaaaccacatttacaaattaacaaataaattgaaaaaaaattcaaaagctggacacacagatttcatcaattatctcagttgcaaaacagaacccacaaataagtaaataagaaatccaaaacatcacaaatgcagtgaacagatatttcaattatcactcaatacagagtgcaatggaatgcagcatggtacatgcaattgcaaaaatgattaaaaaaaaagaatattttaggaacaaaattaaaacaaaaaaagaagaaaaaaagatcattgccttactgtctttggatattccctcacgttgatgacactgcaatagaacattaagccaaccataagtccaataagagacgaaaataaaaagcaaattgagatttaagttgaggaagaagatggagatttaagagacttatggtttgagatagaggattagatctagatcaaatcatcctcaagcaagaacaccagagaaagagatcactcattggccaaataggggcaagaaagtttaaatcctaatacctgactaagatcatcagagaaagaggtcactcattagtcaaatcaggactttagagacatcaagaattaaggaagaggttgccacttggtcgctacttactcgatcgatgagaaatggagcactctctaattggccaagagcaagagaaagaaaatcagagaactgaaagtctaagagatggctgatgaagtcttggggagtcggaagagatgagtcgaaatagtgggccacgtagtagagatttaagagttttcattccaaatctatagtcgtgattcataaatagaaattagaagcactagttttgaattttaaacaggccacccccagatccatttgcctagggaaccaagttaaatgggttatccaacccgacccaaaaattaaataaattaaacgaagtaaacaagttagacatctgaaatctgaacctaatccaaatattaaacaggctaaatggattaatctatttatgatccgaatctatttactccaaattcaaagctatttatggtgggtcgaatatgggttgggttagcggattgggtcatatttgccactcttactcatgggtgagcttgaagaaggaggacaatgatgagaagtaagaaggaaggagaggagggagaagaaaaaattgtcagcaaggaaagggcgaaagtacagagagccaccataaagagggagggctcatgggtgggcctaaaaaaggaggaagacgaggagaagggggtgaggaggaagaggagggagaaagaggggtcatcgatgagaaaagagtggagatagagggggccacgatggagggagagagctcatgagtaggctagggggagaaggatgacaaggagaagaaggggatgaagatgaaagagaggaaagaggggttgtcagtgagaagggacagacataaaaggagtcactgtgaagagaaaaggctgatggatgggcttggaggagaagatgatgagaagaagtagatgagaaggaaggagaggatggaaaaggagaggttatcgacgaggaatgggcagagatggagggagccaccatagaggtagaggtctctttgatgagtttggaggaaaaggaggaggataacaaagaggagaaggggataatgaggaaggagaggaggatgaaggagggatgttagtgatggagaaagaggagaaagggagcaatcgaagatgagagagaatgaaggaggtggataagggtagtttggttattttataaaatgatagtactatatgatggccacgtggcatcatttcattaatggagataaacggtaggacaattttagaatattatgaaaacttaaagagccagtttaatattttttaaagccgagcagtgtaaataaaattagactaaaattgagggaatatacttataatttactctaaaaataatatgaactatagcttattgattaagattttggttaggcctccaaagatttagagttcaaatcatcacgtccttgcatatatttttataaaaatttataaaatatatatgggggtgcaaatggatcaagttgatctgtgacctgatccaatctacttagatccaatccaaatctttttaacggaccaatagggtcaaattggattctgaaattggatccattctattttttaggtatggtctagatttactgaattccaatgatccgacttgaacctaatatacgaatccaagcaatcaaatgcataccctaggtatactttttaaaagataccatgttggttcattaagagaaaatgattctagatataattcagatgaattgctagttcctatgtattctttaataatctagtttgggttgcaagcctattcttattttgtttttctttcaaaatttatagtggtatatggagatagtgagagatgttgatgatttgataatcataacaataaaaaatacataattaggtaatgtctgttttagctcttgacacaaagtcggagcatcatggtctgcacaaattcaaactaaaaacactgcattgaagagaagaactcaaaaactttctcatatcttttacttcttcttactagaatttattagtgtaagtgcaacatagctaggatccaatccaaacctgaatcaaactcgatctggacatgaattatttggattggggccggattatgcatggacttgactcaacccaaataacctattgcgtcaaaaattttgatcttagattcgatccaactcgatcttctattaaattaggcctgggtccaatattaaaatccaatcaatgaaccagatcgagccaaagtcactcgtgacaatccaatctaatccttttagatcacggacacctaaggagcaaatcccaaatctgaatgaattttaattttaaatctcaaatctcataggatattactaaatggatcccatgaggatttgggatggatcgggtactcgaaaaaactcgctgccatccatattttagacttagggttggaaatgagatgggccacacccttaacccaaaagtggtccaaaacctttctcaagcttaggctggatttaggaccaaaaattgattaaaaaaaaaacaccagtctatgtctgacctatagagaaagaatagaggagaagagatgacaatgttatccctacatcccccaataaatcactcctttccactcctaattcttcccaacttctcatgcgctcaccaacgatcccaagctcaagcactcctcctccacaaccgctgccctggtcaaatcttcggcatttatcactgtcgaccctatcttagagaaccgactagcctaagttcgacttaagtaccgaagcagcattagaaagaaggtgaagcagcgataagccaaaaaattggatggtggcaagaagaaggtgatgttgctgccgatgctgctcaaggagaagatgacaatgatagggctggcggtgaagataaaagaaaaggagagagagatcatagtatttcaaaagaaccatgcttggccaacgataggagaccgacgactagtgaccggtgatgagggagatgagcttcagggagtcgataaatcgataaccctagttgatgaccgatgattttgattagggatcaggatccaaaactacttgggcatggccatagcccgactcaaatttggcttggacccacttccagtgaggatccactggatggcctggatggttgtggatctgcttattgctattatccggccccaaaaagttctatcgatatttaatagtaaggctgaaatttattcgacttggtgctatccgtcttaagatcaccatgtttttgaacaaagcattgttaaataaataaaagagcagagtaaaaaaaaatctcgcatttaacctagactaaaatccaccgatgatactacaggcactggaataagatggttacatttttcatactctcccaacaacgcctactgtgtatcaataggggctggaatgctgttagtggttctacccgatgcccatcaagactcaagagggcacagtttgttcccatgtatttatctctttctgggaaattttatggtcactgcactacaaggtaggatcatcatcactcctcggatattattgttgtagttattacagaacaatatcatgactatgatcatcaaagatatttgggatgatgtttgtaaattcttcttatatatagaacaaaataactagaatatctttatattgttgggaagggatcatgtccgtgagtccaaatctgcactcaaagccaatggcaataccttgccaatcagtttgagatgctaaaaacgacaaaaaaaaaaaaaaaaaaaagatcatctccttcatccaacaatctcatgctgatagaaatggcgtgagcatattcttgaagctagccttttgcaagagtaccgttgtgaaagcaatggacaaatatcccggtaattgatgaattaatggtgaccaggggctgcatgtgcaatgttggggggaaccagaccaaatcgttgcttggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctctctcttcctccctcccccttccttttccacatgggaatagcaccacgggttgcttagagaggttgagcggagaccatgtgcagtatacttgaggtctgacgaaaagcatgaacaagaaagcctatgatcatactctgcttcatcctcaagcctttcacgtacggtatattgtaaccttaacgttcacagttcgtgatgctgatgcaagtatacacctattacatctacggacgtcatcttaagagaagccgcccgccatgccggtgttcttagtactgttcctttgtctctagcgtatggaatggacctttgaattagacatgtgagtgcttgcgaacttccggtgcacctcctcgtaatgcgcgagtgcatgttctgacgagcttcttcgatgtagtgaagtgaaaaaaaaaatattggagaaagaatgatcgttaggttgactaggatttaaataagacggagctggattgctccttcagtcctctccatccggcaggtacgactttgctacctccatttgtggtggctaccggctctaggctctggtacggtacgatcgatccattgtcgatagcaatatttttatatcacagtttgaaaagaaaacgcgtttcctctgacatcgcaggtacgcatcataataaatttacggcaaatgctgctacttgggatatggaatccgatcaagttgcaggacaccccaagttgaactgttacataacttgcatttcatgccaattagcatgggatactaaattgaaggtcaaattttggaagtaacgggtttggatgcagtcaactaaaacaagcagcagacatatgatcgtgcttcttctttaatagaagaggaaatctggagtggttgaagcagtcgaagaactaaaatgtggtacattataaaaacagaggtaatggatcgaattcggcaaagcaatctagtagcctatcctctttccggttttgtgaagagcgatggaaaagactgctaattactttggagctaccctgctgatattgctggccttgctcgcctctgactccagaggatcgatggctcaatggatacctgcctctgccacattctatggaggaagtgacgcttctggcaccatgggtagggtgaccccccataatatttccttggcctttcatctatgtttatacccgacatttgtttcgggctgctttaatcatttgcatgcatgattctagtctagtcttgcgcatcaaatactaaactcacaaagcaaagcctgactttgataacaataaacccaatgcacaaaagaaattaggcaaattaagaactcggatctgtgagacttctcatcaatttccaacatgaacagaccattatcaaatccgatccccactttctgagattccaaaatacaatactgcatgcttcccgtctaaatccctttgggccaggtataaattttgagcaagcgtcgcatgaacgcagggggagcttgtgggtatggaaatctatacaacgatggatatggcatcaagagcacggcgctgagcacggcgctgttcaacagcggcagttcgtgcggtatgtgcttccagatagtttgcgatgcgagcagctcaccgtggtgcagaaagggcacgtccatcacggtcacagccaccaactactgcccgcccaattacaacctgcctaacgacaatggcgggtggtgcaacccaccgaggaagcacttcgacatgtctcagcccgcctgggagaccatcgccatctaccgaggagggatagtgcccgtttactacaggaggtaatgcaattctcgagtgcaactttttgcgaagcaaaacacacacacacacacgcacgcacgcacgcacacacacatatatatatataagctaatcgacattcccatacatctgcagggtttcatgcctaaggactggaggcatcaggttaaccatcaatggcagggactactttgaactggttctagtgtccaatgtagggggcagtggcgtcgtctccggcatgtggatcaaaggatccaacaccgactggatggtgatgagtaggaactggggcatgaactggcacagccttacctatttgaatggacagagcctgtccttccgggtgcagacagatgatggtcaggtcaagaccgcatataatgtggcaccttccacctggaagtttggcgacacctacgccacatcaatccaattttaacacttgatctggagtttcagcgcacagcagcaacagcatgccgctgcgatcttcttgtgtcatttttcaatcaacaaaaaaaaaaaatcttcttgtctcatttgtttcctcttccctctttaaggtatcatattatcccttacctaggctgtggcttagataaaagtagcccacctagcagcatgattctgtggaataaacgatcaaagctccccttggttccattcttctgttcgcaagctacttgtataccttcaatagaagctagagcagtcctgaagttgattccaggaccgaccatccttttcgttaaattgagggggggaaaaatacaagagccagtggagccaccatgtttgctgaataattacctgatctgatgtgcttaatattagtacactaaggataataaaccacgattggtggatacaatatttcgttgtgcttgtaaacttcaataggacctgaaattttaattccccactgaacattagtagaaaacgttacacactgattggcagtctcgatgacataactttgtcattaacaaccaacaatcctcatcaaatacagcttcatcaacaactaataaaattggaaaaaagatgattgagactatggcctttatttatatctctaccatagcctgcaccgtcacatggttgttgcgattatccaggaatcaaagaacagcagaatccagtaagttaagctgctcgtgaatttctggggcaaaaagtgaagatcaaaataaatgacgcagtacacctaaatttattccaattcatcatctaatctttcattggcaacataccaactcttggcaatagagcattgattaatatcaacttaataatgtcattaacaaattactatatgaatttatagatttacaaacactaaaatgagaaatatggcatccttattacagactactgcagaaacatctattcgagagtctatacatttattacacccaataagcaccccgctaaagcaaactagtgagaccaccatacttttagctgaaaactgacaactattatgatattgaaatggtatgtgtttacccaagtatctaaaggcacattacaaaaataagagtcagcaaaggcattatgaattcccataatgttcatgacatcatgaaatcacgtttattggtccggtatattggtctgtgctgatttggctcatgcaatggggcatcccataccatgaagttataaacctcatggtgcagccatgcttttcaatagttaatgaccaaaattttgagattataggcgaaaagggattccaaatgacagtacaaaagtcgattgacaagttcaaatatcaatcttcgaaaccaacttcatggaaaaaacatgtcacctagaagcagtcaaatacagaccatagcttacatttccttcagattactttcttccttcagcacattgcccgtgtggtaccattttgagcatcgcccaaagtagcaattccgcaatccttccgcttgcctatctacctcaagggatgcaacatcctcatcaatgacacgattaagttttcctgcctctaacctcccagcaaaaattattctctcaccatctttatcttgttcactcttcgacttcaacaaaaagcagcccatttcaatatgatcaccgtatatgctgaagttcacttcatcataaacttgatatactttgaattcagccatttccccatgaacaagtaagatctctcttgctgcttgtttctcagatgatacaaacatatgaactgccatagtacatactttaacgttagttatagtattactgaatctgatgcctagtcttatcagcatagttgtggatcctggactagatgctcatgcttctttgcagcagaataaaggtgatctcaagtaagattttgaagtacagaagatggtgcaagaaacaagtaatagaaatttaatttaagaaaaatatgcaagaaattcttgtggtcatttttaataggcaggtacaagaggatttccctcactggaacatcatatgcaggtataggaggaacattatatattcatacacatcaccaaacttcttttctacacagcaccaatatacaaagaattcacaatattgcccctccaagaatcattgagtttacattggcaagcaaaacaaatattcttggtaattgcttctttattaattgaaataaacttccttgacagagaaaaaaaaagaacgaaagcaattaatcaccgctcctcaaacttaatcaagagccaaccagctctctcctctagcaattagtgatcatttttcaaataataatggatatacaatgtctaaactatttgcttcatcattagtacctacatagtttgaggacaaccaatttcatgctccatacatgttagaaaaattttgtaatttcattgctagataacataagtgaaccttacatggcagcttggttgttttccaggtccatagatatctaatactgaatgctgaacaccatattatacgataagatggactgacttcttcttaagagcaaaagcatccacttggatcaaatttcgagccgttgaatcaagattttgccaaatagaatgatttagagacaatttttaaaaaggaaaaacccttcccctctgttgcaagccagagatgtgcaaccctatggtttgactaccctagagcttatgccaaatacaatgatttagaaagttaaatttttaaaaaggaaaaccattcccgtatgctgcaagccagagatgtgtaaccctatggttcgaccaccctagtcataattacttagggcactacaagttagatccattggaagtgctcatatggaagcccaagaactctccaggaaccatgtggatcaagctctgatccattggtaaacatccactgcacaaacattccgatgccaagccaactgcagtcaaaaggcaattgacggtgaacaactgaccatcagaagaagtgcccgacagtgccacattcaccattagaagatttccaacaatgcttcaatcaccatcaaaaccagaaaggtacatatcccacctctattctgatggtaatgtatcaccatcaaaagatttttgacaatcccatattcaccgtcagaaaccaccttctagaagatccaaccacacattaccaactacccgaaggactaggggtccagtccgagctgaagatcaagactaagaaaaccgatggtgaacctttcaccatcaaattagaattgacggtagcataactaccattcgaagcattccgacggtatctaggatgctggcaaaatacttttccttctacaaacaccctttcggctagaagtcttagtttaggtgttttacgagttttatttcaagtttttcaagaactggtataacacccagctgtccttatcccttgtaaccccttgttttcacaagttaatgagtttttttttcttttttttttctttttgtgtgtgttgagggggggggatgcaattttgctccttttttcttgtctaatggattctgtacaagtctcgatagaatttggaaatgacagcgaggccaataggtgcattccttggttgtggcatgcttcgaggcatcaattggtgaattccttggcatttagaagctctttggtcacaaagtgaagaaactactaggtaccttagctcttcgatctagtttgcctaggcctctagtttttaaaatgaatttcttactttgtaacttctagatttaagtcatatcttgcttaagacaattaaattcttgcttagatatttacaatcttccactactttaaagctaaagtcaagccttctccacccacatcaacaaataatagtattcaagccagctctttcctagtttccctagcacaatcctaaccaggagtctgatgctggtaactcaccacaccataattgccataataacaaccagaaccagcaacatggcaaggataaaataaaatagtacgcttgaccatagacgacttctttagaaagttggagcatgcagcattccaaaattagctagcttcaattaatgactatttcaattggcatcacttatccgatcggaagcaagtccaatttgttaaagctaagtgaaaaggcccagcctgcatctggcggtctaccttgcacagctgagtctattgtggtgcaagacccatcacaatgtgggctcagatgaaagctgtaagattgctacattctttgtgactactcccaaaccctttacacttggatgctccagctgaagcaaggttccagattagtgcaggaatactaagaggaatttgataagattattctacgcttcatttcagcaagatcacagtccaataggtggctaggtttcgactactctagtgatgattacctggggcctcatgaattagactcatcaaagggtcatatgtaggctcgagaactctcaaggaaccatgtggatcaagcatctggtagcaaaaatcccactgcctgaaatgttttgatggcaagctaactgctatcaggaggcaattgatagtgaacaaattcaccgtcagaagaagtgcttaacaacactgcattcactatcaaaagacttccaagagcatcacaatcgtggttatagtgagaagggtccacgtcccacctctattgcaatggcaatgtaattaccattcaaagacgcttgacagatccatgttcaccatcagaagcctccttgtagaagacttgtagatgaagcaactgacactgagcctgactccttcaaatcggatagcacagtgtcaaccatccaaaggactagataccaagtccgaatcgaaggcccaaatggagaaaactgatagatttcatgtcagaagaaaacctacgatagcataagcattgccttaagcattctggcaacagctaggtcgtcgttgcaacacattttcttgtagaagcaccctttcagtgagaagtcttagtttaggtgttttaggagattttttttaaattttaccaaggactctcataacatcagtcatccttatccctcacaggcatcctagagcctataaataccctctatgtacctcctgtattcccagctaatgagaattattttcttttgggtgctatctttctccctttttcttgtgtagtggattctgtgcaagtcccgacggattctgggaacgatggggattccttggtcatgacatacttcgacgaatcagttggtggattccttaacatgtagaagccctttggtcgcaaagcgaagaagctaataggcatccctaggttgtagatctagtttccctagccttccagttttcaaattaatttattgcttttgaacttctaggttttgatcatatcttccttaagatgattaatttcatagataattataatcttccgctccactatgaagctaatgttaggtctccttggcttgcaccaccctctctctcaccatccttcctctctccctctctacctcccacaccaacccccctcgtccattcactgcacaccaccatccactcctccttggtcccaccacatgttccaacttccaccccttctctgccttagctccaccatggccacttcacgtttgcttccccatccatactcataataacccatctccaccatcctccaccataagatcaataccactagccccttcctccaccaactacatcgaccatcttgctcttcctctatcataacccacctccaccacccttgtccttcatttgctccattcacccatcccattcctctgccacaagcccaccaccccaacatgctctcattcatcaacccttcacatgccatgaacattgtggaaatcatagtggaggaattgggtgaaggcgatggctaaacaagggggttagcaatcatagtggaggaattgggtgaaggttggtggctaaacaaggggattaggaagggacagaggggatagggcaggaagtgaaggtggaggatggggcataatggaagggaggataacaactagggatgacagtgatgtgataatgatggtaatgggaggagaggtggatgaatgtgagcagtgaaaggacaatacaggacatgacaaaacacgctgggatgttgatagttggggtttattcaaattcaagaaagatgattctcatttatctaaactgaacatatttgaccccaacaatctaaaatataacagaagctgtccccacaacaagaaaataatccatctcttatatggctaacttttgtcaataatctgatcttatgagtgtcaaaaaagtcttgctgaaaagtctatggctagacatatgaaagaaagaaaagagaatactagtgaaaaatgaaattaacaaggaaaaaaaacagatattacaaaattgcagttatttaatctaaaaaaccaccacttaaagcaacaaacaactagcacacaactgattatgcatcagtacatagccagcagcaaatgaaaaataagtctctttgacatgactattcatattgcccagagtttaccatacttagaagaagaaaaacaacaattagaacaaactaatcccataaaatgcaaatatcaattaaaaatgttcattaacttcacaagaaatttgcatttttgaattagtggaaatcaaattcttagaaccaaaacaatgatacagagacaatacttaaaataaaagccactcctggcctttcttgttgactgagataatgttgcggacttacatctactactatctgcgcatgacacgatttctttctctcttgcgaaaacgctcgagcatgaactcatctgtggcagcttgcctcctccctggaacatctggattattagtttcagtcgatttggttgccacttcactagtttgtgctcctcggtctttgtacaattctggatgctctgcatgtagaaaaactaataccgatgagtgccttaaatgcaaaacacgtgtggtatcaggcatgagtaaaacacaattacaattcaaaaaaggctgataattgatgtacccaattaaaaagtgtggggatggctaaaataacacataagaaaggccactcattcaattgttaaggattataagaggaacacatagcagtcaggccaaatatatgtagttagcaataaaggatttatatttacaaagagatggcaaagcggaaaccaggaaatgaagcaatactactacaagatcagaaaaattaacttagaaatgttgggaatatagaagatttggtaaaaaatgaatgctgcactgtgcagggatgattcagtctatgaactggcttttccatagtgttatatgtgctagtctaaatagcatctcatagtgcacctactgtaggagacaagaatcccagccaaaacattaagccaaaaggatgaaaagtttgcttaaagaatatcataaagattctttgagcttattaaatcaccgagacacctaatctcatattctataaatagcaaaagcatattttttttaattaacttcatggattgtcaatttccttttgcattaatattcaaattcactaggatgaaaactattgctgccactacttaagttggctgatttgtttatcaatacttctctttaattagcataaaccacatctgcaggacccccaacacccataatagatcaagttgatactgtcacaaattatgataacactccagttaaacaacaagcttcgaaagtctgtgtatagtaactatcttttcacctgctaactcttatctcaagagtaaaagagaggtttttaatttccactaaaatcaaaatgaaaggggtggcctagtgcatgaggtttctgctactatgaggtctgaggaggtcagatgtatgcagtcttgtccacgtatgtgaaaaagctattccatgtttcaatcctgtgaactagtgacattgaaatcagaatgaaagtcaaccatgattttggttttggtaattttattcaatttcagccaaaactaacaaattttggcccagttttagtcacttttgctactttcagtccaaattaagcttaagctttatactgtatcattttattttcaagtatataagctatatagtatcaactttccaacaatttctttcttttgctgaattaaaagggcagatagacaataaaaataatagttgatgggtagaggcatcaggaaagtcccttactaaattactttataatgacttacagctaaatataggacttttcaaaggaatattatcttgtgcatttaaaataaatataaaattctataattgaatggatttgactaaataaccacttaacctaagtatataagaaaaaagctcaaattcaaaaacattgtgaattttaaaagcataaaaaagatttgaatgcagcaatactaaaaaagcttaaaatttctaagtgtaatgaatttttgaataagtgaagttcaagaaataaataattatgcatgtatatatgttcgtatgtatgtatgtaactatgcacatgtgtatttattatatatatatatgcaaggttcacaatctcaacaccagactttatacctttatcatgctaatacaatgctggtatatgctcagtgcagagattggttcggcagactgagactcggcatgcctcccatcctaagtctcgattcagtattggtatggtgtggtatgctcagtacacagcagtatgcactagtatggaccttggcaactgcgtatgtatgtatgtatgtatgttcacaagtttggtaatttgtacacttgctaagtttcgcttatatcaaatattaatttcaactaaataaataaaaaacttatataacaaaaaatactctgaacctcctaatattgcattacttttttctgcaaattttcaaataattacgattttttccttttttttcatcaaaacaatgaaagttggagcaaaacttcagaaactgttgaaattgaaagcctaaatagctaaaggaaaccaagatacaagtatctaggataaacaaataagcaaaaggagacataacgtccaacatgcatgacaaacctcttcgaagtttttcagcataatctcgaccacgttgaaaatagtcagcactgtaacttgagggaatattcaactctgatttagctttacccgcaagtcgcttctcttgcaagagctttttagcagcctctgtttcttcgatatttcgtaacttatatctgcagcattaaagaactgcatgtttatgccaggcagtaagaggcctaataatcacagtatatagctaatagaaaaaagagagcaatttaattcttgctgtctatgaaacaatatgctattacactcttttagctaaaacattttgctacaagagtgatatgactcaaagaatgcatattgatgtcattattgaaatcatctctagcacatttagtccatttaggcaaacattacatacaaaatgccactagcatcacttcaacaactatagcacaattgatcgacactgataatatatgtcacaaatcttcagctataaaaacatgtcattcagcaataattatttgttggatcttgtaacaagagatcgcttaatgattttaactatgagtagaatgtggttgtagaaaaaggagatttagactcttaaagacaaagtagccttaatatgtacacatttgcaaaaatggttttgggtgagaattcaatgatattcattgagtaacctaggccttgtttagattggtggcattacatctgacatcaagataagtagccaaatttacatttttgtcaagtccaagttttaaaatttccacaggtaagagcatatctattacttttttaggaacacactttgaagaaatccagtagaagaagatttcaagatgtcaattggtaaatcaactgccatagcatgggtcagacactagaactggagtggataggatttggacatacaaagtgaggttggtcctggaaacagaagctagtttgggaaaaaaaaaatataatataatctgttataacagagatattatattaaatttaattaagtgatgtttcatacaaagttattgaaattgccacagatttaaagtagaaaattccaatgctgttcaagcattaagtagcttgtaggcatccaagcaaattccaattcccacccctctacattgtactgttaagtatcatttcccctttcatcttccctggggatcccagtcatgtgaactattataggttcctcttccaactgttcttccagtcatctcccctgaatgtgcaagttgaggaaaccaacagattctctgagaagcaagtacaaaagacggggaatgtaacgtatggcagttgcatttctcaagtacagtcctaggaaaagaaaccacccattcccacgatggagaatagtccattctacaaggtgataatgaaatcttggtggcctagtccaatcaaggtgcctaaattttgcaaacaaactataatggttgctgcaggtaatgatatcaaagcaaatagttggtcgaaatatcttctatgagtttagtcattgaagctgatgttttctcaaagttgaatgtaaagagtccaaattctattctcgaagcaataatcatgattcaattttaagtcatgcttgtaaatagaaatcttacaaggatagaagccatgcatacatacatttctcaactagcataaacatttacaggtacttataaggaaaatcaaaattacaggcaggtaagaagtagcatggaggagaagatgacaaaacatactcgatgggaagctgaacctcagcaatgccagtggtccattgagtagaactctcttctgagttcctctttttcacctgcaagaaaaccgatcacagaaaaaccaccacttcaatgcgtaatctaactagcaagaaggtgacgctcaaaaggggcgaaaaattctcttttttggtcattattgaccttgagatgctcgggcacaatatagagttcatccatgggatccttctcttccttgtcaccagcatcgatcttcttgcctctcctcttggccaactcctgctctacatacttcaacctttgaattaaagataggaaggatcaaaggatactaatttcaggcgcgcgccagcaaaaagagagggagagataaagacagaaagaaaggaaattagttttgatataaatacatgttggggtcctcgacggtgacggcggtctcctgggcgaaggtgtcctggaggacgaggtcctccttctcgccatcggcgtcagccttctcgccggggcggcgagggacggattcggcgatggggagggcggggatccccggcttccgttcccgctgcttctgaaggaacttcacctcctccaacgccaacctggccaaaaaaagaaaaagaaaaaagagcattttagcctagaatcctcttcgatttcgcctgatacaaaccctagaggcatgcatatgcgtacctgcgctcctcctcgtcttcggagtcagggtcttgctcgaggctccgcttccggaaatttttgagggcatcctccttctgtccttctcttcctttgactctgcacgaacagaaaccccaaggagcttccaatatggaggatggatttcgccggtgattccagaatcggacaccagcaaaaagcaacgcaacggatgcccaccgattattgttgtgctgctcctcggtcaagtcaaacaacgttactaatcctctttcaaggttggaccctatctatcaatacaatgactcaagctgtcccgctttctttcgacggtaccccaaagggcttttaagtccttttgccatcatgtatccctgaccgtccgattgagtccgatcgaacgtggatggctttgattgacccaatggcaactggctgtgccttgcgaggggtagggtgcaaatgggtcaggtcaggtctggtcacgagtgatcccgatccaatttgattctttgattcgatcctaatgttaggttcatactcaatccaataaaagatcggattaggttagatcaagtccatggttagaattttcaatccaacgagtcatttggattggattgagtccaaatataatccagcgtcaatccaaaagatttgaatccagatttgatctgcatcagataaaagtctatagccaactacattttaactaccatacgatcaactactattaattacacaaaataaacagtaataatattgttctcaaaataaattaggatacaaaaataattctgaatatatttttatattaaatatattgttcatataagttttaaatcataacttaaagactcaaatgaatttggatcgtaatgatatactggattcaaattgggttggatcattaaatagaagatctaaaattgatatagaaatcaaatggatagattcacattaaaatttaatgaatctagacccaatcaaaaaaatagaacatactcaattttagaacttaatccagtcccatggattttttaaaatgggtcaaatcaaatcgaagtggatcggacccaacctatttgcaacattagtcaagagtgtttggaaagttacactgataagtattttatgattaggccgaaggtcagaagtgtttaggaagcccttttataccatcttagcagcctgatgccctacattatttttggaggcatggatggtgggaagagaggggttgcggttttggcacaggagaaggagtgcgaagaggaagaggcaaagatgctggagagggagtggatgaagttagtttttagttaactttttagttaactttagcatgacttcctaaaataatcatagctttttaatataattctaaatttattttttttcttttgtgtacttcgattttgactaataatttttttctaaattgattaaaaaaaattccactcaaatttgaatttttaaatttttttctacatgcatcaaattagttaatggctttctaaaaataattattatttcatttataaatgaataatattttttaaataattaagaagaatctcatttatagttaaatttattttttgaaattttcttcaactttctaaaataactctaaatttgaagctcttatgtctagactctatatggctaatatttttttctaaaataattataaaaattatactcaaatctaaattttatgttaattttttttccttttcatgcatggaagcttttttttttttttgaaaggataacttttgaaatcaacattaatatagatttctaaaatatttttgagtcaaatttttaacttaactttaaaacatgttcctaaaatatttcttctatgcgtggtaataacatatttagatatctgtaaattatttaaataacttttgtatttttaaaaaataattgtggagattttagataattattctatgattgtctttcttttttttttttgaattttggaaaggagttttttctctcatttcctttaatatgtaggataaataaggaaaaattatccatttgagtttaaatttaaaaataactacccatctgagttttgagtaaaagcagctacatatttgaaatataacttaaaagtaattatctaaatgaaaatgaaatgacccaattattctggtagttataaagcaatactatactattacaaagtaatactatactacaccattaaaagaatactatactaatataatataatatttttttattataaaaaaatactacattaatataatacaataaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacacacacgcacatatatatatatatatatatatatatatatatattctcaactttagttgattaccatggttgtgctagctttcttatgcttcatattggcgccgcgatgggaatttacctcgaattgctaatcgcaatgaaatcaattttgtattggtcgttgtgaaccgattttcaacaccattttggcataaatttcctgtactagctgcaggataagacggaaatacatacttaccatgcatggtttccaaatattttcttagatatttctattgacatagtaagtgacccttttatcgcggtgattgagtatggaaccttcaagctttcctcatgctttgctgtaaagttgcatccgttaatttagaaaagaatcccaaaaatgtgtatgttttctattatttgatatgcgagagatttcttctgcttctatatcttcttactgatagaaattgtatagaagaggcataaaactgcaatacctgttcatttatataacagaatccgtatctgcttctcctgcatgtgttgtcatccactttctttttctcaaaaaaaaaaaaaaagggaaaatccttctaccctcaattggaagatagtgatatcggttgaatctcactgactaggttgctgtacgagctgcgcggttcgaataaaatctggtcaaatcaaacaacctgaggctcttggaatatctgcagagctgaaatctaaggttgttttgctttcgcgcttttttatcttgcagttcattagtaaagattctgcaattaactgatatttgcctgtcttatgtacatgagactgcctacaccatgaatacttttatatttaaccttataggccacattggaataacctgcttcacttttctgttttcttggagtgaaattctcattattttttcaatgcattatcgtataacaaattcaaaaattattaaccctgagaaacatcagcatactagatgaatttgaaaactgatgcaataggcaatttttcttaagaggctttatgttcatcataacttgaaatttctttatcaagccacagtttgtctcagtttttttgttcaattttgacggagttggactttcatccatacttaatatcaagaaagatagataaggagtggagggttcacacccgtctagaaagtaggaaatattggcttttaaacttccacttggaaagatgcagtaggcatcagttcagtgaaaagtatcattttttcctttgaatttcttatcagatagctgtgggttcaatcttttcaggaagaaggaaaaaagaagaaattttggtcttgcgaattgaatttgactccttgttggcaagagagtcagagacatacctagatgggcacggcaaaccttatataccagccaatcatgttattgctctcatcctcagcatctttaggccaaatatcagttgttcacatggacaaattaagtcagcagatgttgctgtggtttctcttcctgatttggagttagagccctcttatgggagaatgacaacttattgtttcttttgtttcccctcttattagatggtaatcaacatttatgggttcattgaagaatcaagaatgtgcatagtgcgaattaagtaagaaacgggggtccaatacactaatggaaagttgtttagataaatagacccttttgataccctgccacagaaatggtttgcctcctcattctggaattagaatatttcaaggaaaaaatcactaaattcctcgttgttatcaaggaaaaaaattcattttgctttgagatccttacataacaaacaccagaattctgaaataattcccattcaatcaagagagctgcttcaggctttttacaatgccaactaccttgtttgagtttgttattactgtgttgattcctgaatcagggcaaattcaagacactattgcatgtattactatttgatagtgaaggatattattgtagtttagcggttttccaacttttgtatatttatttgctactaccatcttttatcaggtgttgacatagggcttttaaagaccattgcaggcttatttcattctttctttaatgtataatatagtaacttgttgcagttcagattgatacttttttgaaatatttgggaattatatacatcctgtaataattggcttaacatacgacacaagttgcagcagttataaatagtataactaacatttcgtagtccatataggcagcctgaagatcacctgctggtttggacatttgcaatgtacttatttatctttatgttaatttgcagttctgaataggggttactggcaaaatatggtggtcaatgttatagctatgccttttttcctcatctcattactgttttactatttctgctgatctttttctgcatccattgcagccaaccatgttgaagaagtttgaaagatcattaaaattatttcctttcgtttcagggttatgcattactttgtgtaggcttcccatcatcagatattgaagttgaaactcaggatgaggatgaggtatgaaaatccaaagaaacagccgttaaaactatcaaaataaagtgccaagaaagtgaacctgtaaactgtttcttttctttctaaatatggtggacagtttttaatatgatatacatctgtaaatataacctcctttcctttgtaggtttactggctccagtttggacgatattttgcacgaggacctattgtgagttttctgagccttctctctgataagaggcataattagattgcatacatacatacaaagctggtgtatgtatgcataagctggtatcgacatgctacttaccatgtgttttttgcaacacatggtataaattctgtttacttgcacataatttgaattaatatgaactttgtttagttgcacattatatgtattcgtaattgcttccaataaaatctctgtgttctgcagaattttttgaggagttacactgatttcatttcttgatcaattaactactggcttgccatgcaggaacgggataactatgcactggagctggccatgggtgatgaatgattcatgcctaatggattaaaaccagagtctatcctttatacagaggcaagcagtttttcttactctctccaagctatttcagtcctcaacgtacattgcttgtgaacagctgtatttagtttctgtaatcttgggacttttctcatctttgtgacttgttagtaaaaaggctctgttctgtaggtcccatcattcgataggaaagtgaaatcaaaacaaaatgttcaaatattgcattttccagacatcaaatttcacatcctatggcttcatacagagcaggattccattttgtgaaaaactgacagccaccaagataccctgggacatcagactgtgatctgcaatttgaagggttgcttgctgttgcttattggaaaattcagtagaaaccaagtaatggagttggtggtggtttagaaaccagaagcaagtgttttcattagctggatggaactttagtaggaacatgaaaggagttggccaatatttacctctacaagatcacacattttatttttgtatgttgtgcagaaaaataaaaggatcatgtggttagcaacatcattataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatattatatatatatatatatatatatatatatatatatatatatatatatatatatatattattgcaacagaaataattcatgcttgatttctggttgatctgacagttgaaccagtgacccatgactgttttccggtttgaccaatggtctgagttaacgttgccgcgaggggtacaaaggggtcgtaattgccagttgccacttattgcaacggtatcaatttttcaaattttataatatgaaccacttattgccaccgaacgttttttttttttgggcgttttctgtttttgaatatgaaagcaagcttctgcatttggctcaagtccaaaagcatgacttcaattctagtgtggataaaatcaaacccgatccacatccaaccaattgctactagggattatgcttctagcccaccagctcagtttccctgcgcaccacgaaaagagaaagacgaaaaaataaaaataaaatcaaacaaaaagcctgattcgctggcgaggtggatggcgttagcggggtccatatggcttcactcgtcgccaactttaatttttctagtttttattgctcttcattttaattgcacgggctctctccaatggcttcctttcgactgcttggaagttagtttgctccaacggcttcacccgtctctacccttgtagccatctgcagaattattcgtgcgctctcttttctgaaaaatatgggtgatttaatcaaactcaactcataacagataatcgccacttccagagagctaataagtttttatgcgaaagagaacaatctattcctcatgcaacaatacaagtagctttatttaatcaatgggtctaaccacaattctaattgaaaacaaccaaaaagatgattaaatgctgtccaaaagatccgaattaaaaaagtcaaaatttccatatagatcaagtccttggtacgcatgaggggaattgttgaagcggaaaaatcctatatcctagttataattgttatctcctaccctcaaggtactattttcatagtattagttagcttgctaactactttcatggtatttttcctccgtttagttcaaattctttgtatttggttgggattgtgagagaaatattgaatagagttgggaaaatagataatctccatctatcatttggttcaaaaaattttaaagaaatggatgaaaatgtataattgtccatccatttagacccatcaattttgcatccttccaaattatgggaatacaaagaaagttggatagaacatagagggatggtttctacattgaaaaattatctcttattaaccttttgtaaaatcctgacacttttttacctttttatttattttatttatatatatttattttatctatattatttatcttaatatctggacacttcttcatttttttttatttattttatttatatatatttattttatctatattgcttatcttatatttttaaatttcattatcaattttttaattttaacatataatttctataattataaatcaataattaaaattatactctatttttattaatattcattattttcagttaattatttatataaaattagttaactacctaaatcaaattataaattaattatttattgtataatcaatatataaatagttcattcatatatattttatttactaaattaaattaaatatttatagatttataaattttaaagattgtaccttgtatattgctctacttctttaatttctataattataaataaataattaaaattatactctatttttattaatattcattatttttaattaattatttatataaaattagttaactacttaaatcaaattataaattaattatttattgtataatcaatatataaatagttcattcatatatattttatttactaaattaaattaaatatttatagatttataaattttaaatttgtaccttatatattgctctacttctttagtatttataaatattataaattattaataataataatacttttatcaaaggatagttttagtaaaaatatctataaatatcattcattctttctttcatttctcttgtattaaatagaggagaaaattattttcatctatttttttatattttaccaaatatatgagaggatgaatggaagattcatctataatcctcctcatccattcttctttctcgatccatcatttttttaatccatctttcatatcaaataaagaaaaataagttcagagaggatggatgaaaaggacagattttccatccatcctagatcatcaatttccatccttccaaattgagagaatataagaaaggatagatagagtattatgaggataaatttctatattgataaaattatctctcattaatttttttaataaaactatattataattttttatttttttatttaagtttcatatattatttttattttatctatactattaatggtataattattattaaatattattactaattattttaattttaatacataattgttataattataattaaataattagaattatattctatttttttatttatatttactatttttaattagctatttgtataaattagttaactatttaaattagattataaattaagtacttatttatataattaatatatataaattaatttattaataactaatttataaaataatttatttaatttaattagattaaaattaaatatttatataattttttatataattagatattacaaagattataagtatctatattatttacttctttagtataaataaatgtacttataaatcgataataataaaaatatttttattaaaagatattttagtaaaaatattatctaaatatcatccatttttttatttattttatatcaaatagaagaagaaataatttttatccattttttcatattttaccaaatatgtgagaggatatatgaaagattcatcactcctctctcctatccatcctttttcctctatctatctttcctctaatctatctttcgtatcaaataaaggattcatgtgcagcatatttacctgctaatagtggtgcatgttagttgagctaaggtatgaggttgcttaggcttccctcaataaatatgattaaaggagcaacaattgagnnnnnnnnnnnnnnnnnnnncttctccaaatattgtgatgttgctaattcagattgctgttagatgtatgccctagaagccagattggctgacacttgtaaaatactttgagagcataatttataatttaattttgatattaataaaattaaattattttatttatattatatttaataatatttgtaaatcatccattggattaatgggtaagataatacgtattctcaagagttgagaatttgagacatgtgctaattttagttaactcataaattgctctcaatcgtaggatcatcatagagatggtgatcgatccaaaagattgatgtacgatcactctcttcggatagatgagtcttgattttatggtgtgcagacaccgaagcgaaagtacaggtacttgttaagaacaagagtactggacgtgaccatttacgaacaatcacaaggatatctactttttcattagtggcatattcatagctgcggttgtgtgtttagttttttgacctgaggtgcatcgacaattcatcttgagggtgctatagtttgactacaccataattcgattttctagccatacggagtcttaaggtgtatgttggctgtagtatattcattgcagaaattaaattgcataaagatgaaatctatcgatctcgatagaggaggagtagtcctatataaattatgaaattgagtccacaaatctatagccatgacagtgtgaaagatagaaaagagtttctattaggtttcacatcagacttgaatcaagtgattctatcatatgatagatatgaggtttgacaagtttatcttgaccttaattctgttggtactcacgattgaagaaccgaatcacatggtaactatacttagagattcatctttcagttctactggattgccactatatactgctagatgttactgatagattatgagatcaattagaattattttgatgatcgataattctaattagctgaattgaaaagagtttcgatttatcgaaaagagtttcgatgatgttattgatagagatcacaacatatctcactatcagataaaattagacctatggggtcacagaaatatgaattttgatcttggattgcataattagactaagtgtagtttaattggattaggattaattgagtcctagctttgagtttaagggagttatgctagcacatagttaaacccattttctcctacatgatttgggtttcctattagataggatttaacctaattaaagcaacctcaaattggattccaaatgttggttcaccaagattcgatttgacctaattaaattggctttatggggcgtcaaatgttggcgccacccaatgttgttcggccatgacgagggctcacacccatatggatttgatccatgtaagtcatccaaattcagataagagagagggagagggataagccttatctactagtggatgaggataagagatttgatctcctttgaatttaaatttagatttgaattcaattttgaatttaaattgtttgaattcgaattgaaggtggattggaatgaggcgacaacaaccttatcctatctccgtgccaatctaaatttttcattgattttatgtgacaaaacaagggagaaatcagagtgaggtggatctagaagagtcctattttaagacatatgatttgatcagattcgtataaaaagggattctttttgattgaccaaagagattacagctgatcaaactttttccgtgcctcctctcctccattccatgcctcctccctcttctatctctgatatatgaagcacttccacgtccaagggtgttggacacgctatttagtgggttcgaaatgtcgaaggctgtcaaatttgcatcaagaacgagaaggctgtgatctagcttcgatcggagtcctgttggagatcagatttgaatctgatcgaggagcttgctgatctggctagaagtaatcagttgaagaaggagagagcatttgataccaggtctgagtggatgcctatagaggtcagtcacgtgcgtagctcaacagcgaatctcgagtattctgatcatcagactacggtgttcttctacccgcgcaaggtgatatgatcatcctatcatttgcatgctgttttatatttatatgctgatataaatagttcatggatctgatttagatctatatttggcgtgtcggatcgaatcaaaaatttttgaatttcgctacctctgatccaaaccaattcggtgcaccacacgatccttcgactggtatcagagtcagattattcagatcataaatttaaattggatcgaatttgattcagatgtgatctgaagttatgatcagatctgaaaatatttagattagatctaaatattacatgtttagttagatctaaaattattttaaattaaaatttagcatgcggtagactagatcttattgatatatgtgatatatgcatagatctagtttattatctgagtagccaagtattcggaaaagtttatcatcagatcgtctggtcataagaagaagcaaggaataatccctctcttgtccaatcgatggattctcttatgaagtgtagggacaccatatggttatatcccataaagaagaacagtgaaaagaaatttgtatttgatacatgtttagattttgtttctagtttgcatatatgatatttatttcgatgtgttttggatcaattattatatatgtgatatatatttggtttgtagaatttagatctaaaatttaatttttacaaaatcttagatccaaaattctagaatcaaaatctaaaattttataaaatcttgaaacctgctgctggcacgtctatcgaggcaacttagtcctttttgagtcaacttagttccctggtgggtcggctcagtttacaattgagccgactaacttatcaagccacggttagcgagttactgtttgtcaccagttagtcggctcagtcctgtgattgagctcactcattgtattgagccgactcaattccaggatgactcgacttagttctgtgaataataatttttgtatgtgatacaatggaatataatctaaattatttagacatatgacccatgaacttaattaggaattaaagatgaaattaaaagatctaattgaaaattcagatctgacataatttcataaatcatgagttcagggtgtgggtagctcaattaagtctagtgggagcggttgatcaaactgactcaaaagtttattaggtttgggtcaagagtgcttcagaccaatctaatagttgtaagtttgattagatcgattcacagccatatgttatcgatcaattaagatctaattcggctcagtgattcgagtctggatcaataggttaacctgatcgattctaatcaatcaatttgatgtctaaggtaagtacatagatggtagttttttaattaattccgttgtttgatctgaccaactacgttggtgtctaagaaaagtaacggggggacccgcacacatcttaacttggctattttgggagattagtttctgtattagatcaacttgttgaacttgtgctagtccatgccactagattagttataaccattatgactaattaaggatgagacctaaaataaatctttctaataaaatattaagtcttacgattttctatcattgtagttgtgtgggtcctttacagggttgattgttctcgactggatacagtgattcagttgcatcgaaaagatgcaactataactattagacatgagatgctatggattggagatgaggttaggcttgatattttggatacgataagagtctcaatgacggatctattttgtgcaaatgatgggtctgacttaactgagtgggccaatattttggatacagtaaagctcataaattagagatcgaaggtggctgcaatgtgtttagagaaacattggacaagagtcattcacttatcaaatgatccaacatcaataactgttagatgagatggtgagtcaattggtgagaccgtagtactcacttaagactcttaatcgtggaggtcttcgcttctcttctaaaggagtgtggagaatcaaaaaaataggagccctaatttattttaaaaataaaatttttaaaataaattgattaagttaattacaaaatttaattagaaactttgactctctgcaggaacaatgtctgcttccaatctcctaacccgtatcttagaaatcaatagattgatcggatcaaattttaaagattggttccaatacttgaaaatcattttgagttccaaaaaattagtttatatccttgatcaggacctttctcctctcccaatccatccaatcgttgatcagaaagcatcttatgagaaatgattggacgatgataataaagttaggtgctatgtattgacgtcaatgtccaacgaattacaatactaacatgaggatatgactattgccagacagatgctgactcacctacaagagttgtatggtgagcagagctatacagcttgctacgaagtatccaagtgactcttcaaaataaagatgcatgatggacagttggtccacgatcattgtttgacaataatcaaagatcttgaggagcttgagaagctcggcatatccatggataaggacttgtaggttgatctgatcctgcagtctttgactgattcatatgaacagtttattataaactttcatatgaataagatccagtacaccatctacgagttggttaatatgttggttacaattgagggaaccttgaagagtttaggggctctgtacttgctatggagtagatttttttcaagagaaagtctactgagaagaagataaaatttgcaaaaaagcaggtggagagcaagaaggagaagaaggcagtcttgaagaagaaggtcgtcgaaaagagaaagtatttttactgtgacaaagacaaccattggaaatggaactgccctacttacctgacaacactgaagaagaaggaaggtggaccttttggaggtatgctcgtcatagaaataaatctgacagttttttctacatccagttggatgtttgactctggatctagtgctcatttgtgcatttctttacaggatcttgaggatagtaggaggttaagggatagtgaaatgattctatccattggtaacggagcaaaaattgctactatggtcgtgaaaacctatcctctacgattactaatgaaaaatattttaattttgagaaactgttactttatatctactgcgagcagaaatctgatttttgtatcttgtttaacgcagaaagactatataattaatttctttaaggatcattgtgctatttatttaagaaataataaagttagaaatgattttcttattaatgatcttttttagttatatgttgatatttctgttcattatgtcgagcaaaatgtgaatgctataggttctaaacatcttagagataatgtgaacgaaaagtacttgtggcacctaaggctaggtcatgttgccgaagataagattaacagattgaagaaaattggactactgagtctattgacttctgagtcatattcggtctgtgaatcataccttcaagacaaaatgaccaagctgtcttttgtgagacttggggaaaggatcatagagtgacttgctctggtgtattctgatgtttgcagcctatttgatgtgtcggtcagagaagattttatctattttattatctttaccgatgatttttgacgatatgggtatgtgtactttatgtgtcataagtctgagacttttgaaaagttcaaaaaattcagacatgaagtgaaaaaataaatcaaaaaatcttttaaggctcttcgatcagatcgaagaggtgagtaccttagtgaaaaatttttgaattatctcaaaaaaaatagaattatctcatagtggactccacttggaatgcctcaactcgatgggatttcagaatggagaaatcagactttattagatatgatccgttccatgatgagtttcatagatcttcttgattttttttgaggatattattttgattgccatatatgtactgaataaaatttcatctataatcgttcttaccacaccatatgagatatgacatggtaagaaatcgaatctgaatcatctcaagatttgagattatttaggactcagtttatcggatatcttaaagaatcgttaggatattatttctatctttcgaaagatcataatgtgattgtgagtcgacatgcagttttttttaaaaaatagtttattcaagatggaggcatagaaagacaaattagacttgaagagaaagtcttcaaagagcaatgagccttagaacttgaggaaccaattcagtttgagccgatccatatactttctccttcatctcgtaagtctagtaggattttctgtcttccagaaaggtacttaggtattatcttagaggatgtagaaaaaatatttctcatgaaaaatggggtacatggagatgaccccaagatctataacgagatgatatcagatatcaactttgagaagtggttagaggcaatgaagtccgaaattgactcaatacactcaaaccaagtctggatcttgatagatccacctgaaggtattatacatattgggtgtaaatagatcttcaagagaaaatagatgtagatgtaaaggtaaagatctttaaggctagactcatggcgaaagggtatagtcagcataaaggcattgactatcagtaaaccttctcatttatacctatgcttaagtccatctgtacattgcttgctgttgcagtgtattttgattacaaaatatgacaaatggatgtgaaaatgacttttctgaatgggtatcttgaggaagatatttatatggaatagctgtttggttttacttctagtgatggtgatcacaagacgtacaaactgcaaagattcatttatggactaaaataagcatctcggtgctagaatgcttagttcagtgatgtaattaaatcgtttggtttcatcaataatgaggagctgtgtgtattcaagaaggtcaatgaaagtgctatcactttctttgtattgtacatagatgatattctcctgattgagaatgatattctcatattgacctcgatcaaaatttggttgtttaaagagttttgtatgaaagacctaagagaggcatccatcattttggggatcaaagtctatagagatagatttaggaggatgcttggactatcacagaagatgtacattgagaaggtgctgaaaagatttagcatgaaaaactctaagaggggtctagtacccttcagatatggcattcatttctccaaaatgatgtgtcccaacacatcgaaagagattgaatgcataagcaagattctttatgcttccgttatagggagcctcatgtacgtcatactttgtacacgacctaatatcgctcatactgtgagtattacaaatagatatcagtcgaatccagaggaagaacactgaacttctgtgaagtgtatcattaagtatttgagaaggactaaggatatattcctgatgtttggtaatggagaactgaaggtgcaggggtatactgatttagacttcatatctgatatcgatgatcgaaagtcgatattgaaaagtatttttttgtataatagtggtgttgccaattggaagagttccaagcagactgtgattgcagactccatcatggaagcagaatacatcgccgcattagaggctgtgaaggagatgttctggttcaaaaaatttattgcagaacttggagtgatgccatcagatgccgtccctctctactatgataacaatggcactatagttctaactaaggagctgaggtctcatcagaaattcaagtacatcaagcgatggtttcacctcatccgcgattaccttgagaaaggatacatcgagatgaagagagtcaatactacggacaacgtggctgacccattgacgaagtcgttgagctagcaaaagactaaagtccaccttgagaagatggaacttagatttgtagccaattagctttaggtcaagtgagagtttgttagatgtataccctgaaagtcgattgactgacacttgtaaaatatttgtaggatataatttataatttgagtttgatattaataaaattgggttatttttatttatattatgtttaatagtgtctgtaaatctttcattgggttaatgggtaagataacacatattctcaagagttgagaatttgaaacatatactaatcttagttaattcataaattactctcaatcataagatcatcatggagatggtgatcgatccaaaagattgatgtatgatcactctcttcggatagatgagtcttgattctatggtatgtagacatcggagtgaaagtataggtgtttgttaagagcaagagtactgagtgtgatcatttacgaacagtcacaaagatatctaacttctcatcaatatcatgttcatagctgtggttgtgtgtttagttctctgatatgaggtacatcagtaatttatcttgagggtactgtagtttgactacattataactcagtctcctagctatatggagtcttgagatgtatgttggctccagtatgttcattgtaagaattgaattgcatcaagatagaatttatcgatctcgatagaagaggagcagtcttatgtaaatcatgagattgagtccaaaagtccatgtccatggtagtgtgaaagatagaaaattttttttattgaatttcacatcggactcgaatcaagtgattatatcatatgatagatatgaggtttgatgaatttactttgacctcagttttgttgggattcacgatagaagaatcgaatcacacgataattgtatctagaagtttatctttcaattctgctaggttgccactacatattgctgggtgtcactgatggattgtgggatcaattagaattatttcgatgttcgataattctaattgactgaattgaaaagagttctgatctatcgaaaagagtttcgatgatgttgttgatagagatcacaatatatcttactatcagacagaattggacctatggagtcacacaaacaaaagttttagttttggattgcatagttgggctaagtgtagtctaattggattaggatcaattgagtcctagttttgaatttaagaaaatcatgctagcacatggttaaatctattttctcctacttgatttgaattttctattagataggatttaacctaattaaagcaagctcaaattgggttctaaatgttggttcaccaaggttcgattttgacctaattaaattgggtttacgaggcgtcaaatgttggtgccacccaatattgttcgaccatgatgagggctcacgcccatatggatttggtccatgtgagtcacccaaatttagataagggagagggagagggataagcttcatccactagtggatgaggataagagatttgatcttctttaaattcaaattcagatttgaattcaacttcaaattgaaactgtttgaattcaaattgaaggtggattagaatgaggcgataacaatcttatcctatctccatgccagtctgaattttttattagttttgtatgataaaacaagagaaaaatcaaagtagggtggatctaagagagtccttctgttttaaggcatctgatttgatcagattcgtataaaaagagattctttatgatagaccaaagaggttacagctgatagaatttttttcacgcctcctctcctcctttccatgcctcctccctcttctatctctgatatctgaagcacttccacatccaagggtgttggacacgttgtttggtgggttcgaagtatcgaaagccgtcaaaactgcataagaaactagaaggctgcaatctagcttcgattggagctctgttggagatcagatttgaatctgatcgaggagcttgcggatccgtctaggtgtagatggattgaagaaggagagagcatctcagaccaggctcgagtggatacttgtgagtcggacgtatgcatggctgaacagtgaaccttggatactctgattatcggactggtggtgttcttctattcgtacaaggtgatgtgatcaccctatcatttgcatgttgttttatatttatatgctgatataaatagtttattgatctaatttagatctatgtttgatgtaccgggtcggatcgaaaatttttgaattctactgcctctgatctgaaccgatctgatgcaccacccgatcctttaattgctacctcacgtggacctcctctctactttgcttggacctcctccttctctgcttgatgccacctctcgtcggtctccgtcggtctcctttcttatcgagctctcacgaacggccacctccatcatcgccttccttcctcacggatctccacccacctctatccatcttaggtgctttccttcccatatattcgaaaaaaaagagaaatagaaagaaaaaaaaagaataaaacttaccaacacaaaaccttagccaccaccatcgaagcttccatattaagccgctccaagtctcccaaccaggactgctgaccgccccccacaccctccgtggccccgcctcgtcgctatcccctcctgttccctctcccggccctagtgaactcgagcccctgcagttgtgtgtgagcaccgacgaccgtccgcacccctttgtccgtgctcctccctcaggtgctttccttcccctctattttttttcttcggtagcattttcatttttttttgcttcaagcctcgcagatgcccactttcacagtggatgaggtggagccatggagcccggggtggggaagccacgagaggcatctgaagctggggaggggaggtgaggggggttggtggcactgaagtcgggggaggggagggggccgggtttggtggtgccggggtcgagtgtggcatggatggtggtggggtgcggccgctacgaggatggcgcggacggccacaacttgggcctcacatggcaggggcgggggtgggggggaggcggcgggaggaagagaaggggaaaaaagaaaaaagaaaaaagatatctgaggagcgagaggaagaaagaaaaaaaatattattattttattattattattaattaaaaatattattttcttacctggctttggcaggatattaaaagagggatggtcggctgtgcatggtaaggaggatggtggagagcttggattagataggagagaagaagatgcatcttatgttgtaccgaaaaatatataggagaaaaaaaatgaatttggtagggtattaaattaaaagatggtgtgagtgggcaaatatgttgacatgtccgtgttttgttccactatatcataatgagtgaaaaaaagagagaaaaaaatagaaaaaaaattatggagcaggttggctataacctctcaaagggtcacccccaccatcccaaacccccggtactgttttacttcaaaaaaaaaaaaatccaattttggtagtggtttttgtaattattttgttgaaattaatcattcactgatataagataataaaatttaagaaaaaattgttatttcgcaggcttatgcatatctgcatgtccgtaacaagaaattctcctgggttatgctttgttatctttctttccttttttgtcttttctgaatgattgttatgataactagtattctattctttatattgtgtaattatcatttgtgaaaactgatagaagaatttggggccagtataatgtatatcttttaaatgttggaaatgcttcttttgatatgttgttgatgttttattgatccttttgtatgatgttgaattactatgcagttgatattctctgaattgttgtttcagaaatccattttttcaattatttgagtaaaccatgagggcatgtgttatgcatttggaactcaaaagttgtaatatatattaacttctatttaatagatacatgacatttccttctcatatgtaagatgtgaaattgttctttcttattcattgttgcttctttttgcactgttgcagaggtctatgtttccttaatttcatgttaattagttgcttcacattatttttccatcagtataagcacattaatatttctaactgtcaaatattatatattataattctgtaaacaacaacatctgaataattaaaaataagatagtaatatttaaaaaattattttcgtacttccgatcccgtgcaacgtgcagatcttcgactaatttgctaaatagaccgtgcttggacaagcttgtttttggatggggtagaacttctctttgtttttgcaaacccaaagtgttcaaaattagcttaaatattatttaaacaagatcaatctagctagttatcaaactaaatatttaagtagtaatttacgaatatctttgcttgtctttcgccctattgacaagctactttcccttaaattttctaggcgtcgtgtttttctccataataattgctacagtgaagtaagttggtgcatatagtgttggtatgttgtggaaacctatgctctgatgattaccattgcatgccttgtgagagccacgaaccagaagatcgctcattgcattttgtgcatgtgaattggatcagatgatcatcgtgggagctggtctccagcctctgcaagtatttaattagtgagttttgctgggatacttttttttataatattttattataaaaaatatttaaaatatttcatattattatttttatattttttattttttaaaaaataatatttttttattattatctttttcttcttccttcctatgcccgaccttgcttcttcggacccgccaccccctccaccccctgtccgtgctacctgcgcctcctctgtcccccattggtctgtccatggctcctctgcccttgtgcctcctctctggcaccggtggcatcggtgctccatccccctatgcgcgcctacggttcccacccccctccggccccccttttcgatgccccgtagttccaacccctccacggcccgtctctctggcacccgtggcttttgcgcccagacccccccctccgcccccgctagtgccattggcttctgcgtggcccccctcccctggctccgccccatgcgtgcccgcaattcccacccctctccaacccccttctcagacactcgcggcttttgcaccatccccaccctcccgcctcgggccccccatctctaatgtccgcagcttctgcaatactcccctagccctgcacacctgcggttcctccacctccgacgtcggtggcttccatggccccccacctcacgtgtgcttgcggttccctcgactgactgctttttcgcgccaccaccatcccacccacagttcttttgctttcgtggccgacgatgaagattttttagaaaaaaaattaatttaatcgtgacatgaattaatcgtaatctttgaaatatttatcgtatcaatcatgcatatggatactttaattagttgaaatctaaataattcatgtttaatttaatgataaaaaatagataaacaataaaggaactaaaatatcttccggagtactatagtaaaattcttaattaggacatgtattacacatgcttaaaatgaagtaaaatagttaaaaaaaagaaaagaaaagaggaatgatgttgttcaataactaaagagaaaataaaggaacgaacttgctctggtaagggtaaggatgaaagtgttgtcggttagaaagtgaaaaagcaaaaaactactaaagatagaatcatgctggagccgatcgcccaaaggatgcagaggcactccaacagttttaaagatatagatgctccaagttgagctaaacgttatctgttaccgttgctatcaagttgcagcagaattccattctgttgagtaactttctatattaattagatattttgttttccgagaagaaaatctttttacctttaattttggtaattctctgcaaataaagacaaggaaactcaattttacataaaagctaaaaaaagggaaactctttttactgatttcgtgcgtgatgcatggctatcacgtggaaggtactacaatccaatcggcatagtttaagggtaggaagctgccccgcacgacactgagactcaagcgtctactcaaactggaggttggtactagcaagggaacaaaaaaaactcccgaaagatacgaggtacaaaccgtaaagttactctctctctttctctctccgtgttgataaagatggctatgatgcagccgtcgacgtcgccgccatctaacggcctaatcgacactggaaagacgtacgcaccctttaaattaccctctcgtttttcctctcatgctatccactgattcatttgaaagataagaacgtgaaaagccggaggttgcgtctttcggtggccatgcacgttattacttatccgttaatatttacgatgatattacgtcaaatttattataaaaaaataaaaatatttatatttaataaaatattatatatttcatcaatttttataaatgatattccatattcaccatcaatttctgatttttgattaaattataataattttgacgtaatattaccattgcaatcaatatcttttccacgtaacgatctggtggggctagcatatccaatttcaggtgtaacataggtaacctcctctttggtcctcttgcatgccttcgtactttatataaatcatcctccaccgtgagagctctcaccattatgcagctcggatcatcgatcaacctttgattttgttgatatatacacatatataacacaaccatccatattgttacgtctcactatatatctagctagttcgaagcaggatcatggtggagaaacgagtcttttgcagcctggttctctttgctctgttggccttccgtcatggtagcaccggcgattcgtcgagcttcgcgaggaccggcggcacgcattttgtcgtgaatggggtgccgttcttctcaaatggatttaatgcgtactggctgatgctcaaggcctcggacccaacgcaaagggacaaggtgtcttctactttccaacaagcttccagctttggaatgagcgtgatcaggacctgggccttcagcgatggtggggacggcgctctgcagtactcacctggttcttacaacgaggaaatgttcgaggtacatatatataatgcccatatatcatatggcaacttcttctcatcagcttaccgtagccgaggagcatataaatctaaatacttggttgcatgagttcattaatttctttttacccaccaactagacatgtaagttttatgatagccggttatacgatcaactcaatcttaattgccacgcatgcagctagcttttccaactcatgattatgctctttgcatatgtaattttttgttcaaaattaagaaagtatgcacgcatatggtatgggtagatatggattgattcatatatatatatatatatatatatatatagtaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatacatatgtcaaatagaggctctgccaatgtagaagcctccattttaatacacacactagattatcgttggatattgaatagtatatattttgctaaaaaattctaaaatcttgctcctcaatcaccagcccttgtgcatgtaatcagccctcttcaaataacaccagggatggcaatcaggtcaagtgaggtcagatatctttctatgatctgaatgcatttatgggaaatctaaatctttttaaagtgagtcaatcgtggattgagttgctggcttgggtcctaaattattaaacctaaatagcacctcttttttttaaaaaaggaaattaaatacatccctgtacctagcacatgcttctttacggcaagcatttggtttatatttttaccaaaaaaaaaaaggcaattcatttatgttaaatgcatgaaattcatggatggaagcagtaaatttaaaagagcaaaaggaaatactttgtcagatttgcaaccgccccttacatgtatcttgtgctatatgtcgtcaattcaaagcttttcagagcctctggatgctccactccaaagagtgggtaaaaggaaaaattaaaggtcaaccatttcttcatcgacctcttgttcgttgttctgctattatatcatgctgttacactggaagagcccgtcatctgatcgatgtggtcagtcgtctcacggccctagctgtatggacactattggtaggacagtgcaaaaggataagaaagtgggaggaaatgagtacacatttatgctcggttacatgacaagatatttgcactgacaattaataaagccctaacctttgttaggtacactcccaactgagttggaaacagaacaagaaaaccactttgttatgggaacaggtcaacaaaaacactcgaaagctcagctccaattgcatggcatcgatccaatcctcaacaaaagaagagtcaggttcactcatcatgttggtaagagtgaaggaattcattaatcagctgagtgcaccagagatctcagactcctccggagcttatcatggctctcaagcatcttgagagagctgatgtgcttccaactatggaagatattatggtatagaagaaagaagatcactggttctacattggttagagttaaggaaaaatttagcttatatagaaaggaaccattttttccatctgagatgctttttaaagaataaaatcatgaggctctcaatgatcaaggcttactgaaacccaaagatgatcatgagccaaagcggacaatacttcatgtgtcgagccacgagtctttgactacaacatgcctttaatagaatgtggggggctcctttcacctaaacaccattctgtagagtacacagattctcctttcactagagaggttatgttcccaaagatggtcacgaactaaaatgaataatacctcatgtatcgagtcatgagtccttgactgcaacagaagggagggatgtattgctttttgaagaacaatgtagattgagcatttcttcttgagtaatatcccaacgttcttctcctaccaaacttgccaaccaactgccgtcatcagttgatcaactgctcttctgattgatggatcaaattttctcttcctccagtctatccagggaccatgcaggtttgagggcccttgcaagaaatatgtagagttatcaattatccatcaaaccagtccatttcatgatttaggtacttgggattttagacttcaaacataacctcctcttgttgttttttttttttttctctcttttaagagaagggaagtagaagagttacgacccgacttctattaagatgagtaattgcatggagggtggggcaaaacaggagatgaaggctcctctttgacaacagagccctcctaaaacacccacagggttgtccacattgatacagaacgcagagtgcaacaagatttcaagttgagaatacaaagacacaagattcaggagttttgagaatcctaacttcacaaggcacttccaacctgtcgttcggtttgagggattagcagacgaaatagacgaggttggcagcagccccttcaaagtgttccataaggcagtgtgcacaacaatacttttcctagaataagacgttctcccacatttggtatgaaaagagagttctttacagaacagagtacatagatgatctctcttctaagaagatcctattgttcctttctctccgtacctcccaatataaagcagctatcagttgatctccagatcttctcattgagtccgaattttttttttctcctccaggaggtccaaaaatcattaaaacaggcagtccaatctctgatactaagttggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaccactatgacaacatgagcccaactatatatgagcccatatatgaactcaacgtaccattaaaccaaaacttatataacttagaaattaaaaaagaacaaatattacattttaatactcccctttaatgattgtttttgaatgcctatgagatttttaaagtagatgaatttctctttgggtaatatcttggtgaatatgtctgctacttgatcttgagtcttcgcatacttcacttcaattttttttcttgtactgcatcttttatgaaatagtacttaattttgatgtgcttggtgcggctatgtagataggattctttgtcatagagatagtaaacttattgtcacaaagtagtataatagcttcttcttgcttctcatccacatcttctagtattcttctcaactaaattatttgttatgctgccaaagtagttgagatatattcgactttcgtggatgacaataccacaatgtcttgcttctttgatgttcaagatatgacatcggattcaaaaaagaatgcacagcccgatgtgctcttcatatcatcaatgcttctagtccaatcactatcacaaaattcaaataattttatattatcatttatccttctttcatatatgatgccataatctttggtgcctttgatgtatctcaagactctttgtgccactccaaagtgaaccttacttgacttttgcatgaatctagaaagtaaatttgatgcaaaaaattatatccgattttgtagttgtgagatacaataagcttccaataatgcttttatatagtggtgcattggcttcatcactttcatcttttttcattaacttctcatttaccatcaaaggtgttactacaatattgtaattctccgttttgaacttcttgagaatgctttctacatactttttttgataaataacaatactatcttctctcagcatgatttcaatttctaaaaagtaatagagcaaattcatattatttattcatatcttctcgtcatttcacttttgaaagtcaaaatcatattctcattattaccggtaatgatcaaatcatcaaaataaagagagacaatgagaatatcgttaccttacttcttcatataaagtgttggttcacttgaacttctttaaaaacttttctcattgaagttggcttcaatttgagaataccatgctcggggtgtttgcttcaactcacacaatgctttcttcaacttgtatactttgctttcttgacctttgatgatgaagccttgaggttgttctatataaattttttcctccaatatcccattcaagaatgctgactttacgtcaagttgatgtagtttccaatctttgtatgccatcatagaaatgagaggtctagttgtgtcatgttgagcaatcggtgcaaaatttttttgataattaattctggatagttgagagtatcctttttctactaattttgctttgtatctttgaatggatccatccggattgtattttgtcttgtagattcacttaaagccaatgattttcttgtcatttggtttctccactagctcccaagttttgttcttctcaatcacatcaatttcttcttgcattgtcttattctatactacttcatgtatagcttcttcatgagttttgggctcaatcatgcaaaagctacaagtgacataaatgtcacttaggcttcttattcttataggagtggaatttggagataagcttgagtttgaagttggtgatggacttacactttgagaagtttgtggtgaaccttcatcttcattttcttcattttggatatcatgaatttcttcattaagagtaataatatttttttaattttttatccttccaatcctaagtagcattctcattgaaaagaatatctctttttatgatcatcttgttgtgcttcgaactaaaaagtctatagccttttgatttagaactatagccaacaaaaatatatttttcacttacttcatcaagtttgtgccttctctcttttggaacacgagtatagtatatacatccaaaaactttgaaatgcttcatcgaaggtcttctactggatcaagctccaaatagtgtcttattttagagagtttttgttggatatctattcattaagtacaccaccgtgtacaccgcttccatccaaaaaaaatttgaaaggcctttgtctttaagcatagatctaactatctcaaaaatagtacaattctttttttcgacaattctattttatttcgctgtatagctaatggtcaattatctttgcaaaccaatatttttataaaatttttcaaatttatttgagttatattcaccacctctatcacttcttagcaccttgatgtagtgctcactttatctttccacaggatttttgaactttttgaagatgatgaatgtctcaaacttatatctcataaagtatgcccatatcatttttaagtagttatcaataaagataatgaagtaaatattactgacatgagaagaagtttttataggtctacatatatcggtatgaacaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgtcatcggtcatgtggttgctacatccattatcaagatactatacatcatttatttgctcctctgtgatttaatatgcgtagaatgtgctttgatcgcctttattttctttgaagaagtgtgcctgctcacttgtttgatatctacaatctttttaaacatggccaaactttttgcaattataatattaaattttttttctaaacttataatcttttttaacataagaagatcttttacatatgttgcatctaggttgagtgctcttatcattttgacttcttgaaaagttattttttttcctctcattttcttcctcttcctctattttgatttctacttctagatgactctcctttaacttgtgtatgactagacggttctctttgaggacttttgtcaaacatattgagcttagattgaaaggcactttctaatgatgattctttgtgcctaaacaatctttactcttgagcttcaagagatcctatcaactcatgaacacttaaagtagaaagatcttagattcttcaacaatagtaactatggtatcaaaatttgaaggcaaactagccaaaattttctcacatattctttgctcgatgatggtttcaccatagctcttcatttgattaacaatctccatgattttagggaagtaatccttcaatctctcatttttttatattcttaaattatctaactctcttcttagagtttgaagtttgatagttctcatattggtgttttcttaaaatttctcttacaagatgtcctattttttttttgatttggtggctctaatgattcttaggaaaattttgtcggacatcgcttgttggatgaagaagagggcttttgcatccttctttttatagtctttcatttgctctctttgttggttggttggagtggatgactcttcatactcactctccactaaatcttaaatctcttatgcaatgaagatggtcttcatcttgatacttcaataaccatagttttctctataaaaaataagaatagaaggttgattgatgtttatacccatattgtttgaatttgtcattaagaacttcttgaatagtgctctctttcccacttgttgtcttcaaattcaaattttgttgatcaaccttgctctaataccacttttgttggctttgtttactaacttgatgaaatttaggaggagattgaagtagagaatgagatgaaaaattgagagagaatatagatctaggtatttttttttcttttttcttagtacacaaggtcatttatgtgtgaggctaccacattttataaaaattcatacatcaatacataaattactatgataatatgagcccatatatgaacccaacatacaactaaaccaaaacttacataacttaaaaattaaaaagaacaaacattacattttaacacatggccattgggattatagaatacagtttctcataagaaccatcaagtaaagatcgatgaataaatcaataaggggggtggatccaacccaagtatccccctcagaatctgatcaataatctatcaccaagtttataggagaggcaggttcaaaatgcactcaggtgtttgttcacatccttccgaattggggataaaccggaaatgttccttgcaactctcataccaaggtgccttctcgaaagccatctttgatttggttccaccattggttagatgatctggttgcaaacttcaaagcccatttagcaagcaatgctatgttcatttgctcaagattctccacacccaatcctccatgttcgatggatctacaaacatggtctcaattttttttcttttttgatggcaaatgggaggtttggtctcctaatgttaggagatcaaccaccctaatttttttagataatgtgtaatatattataaaaggtatttacagctaatgacaaccttgcttgtttttctagtagttttctaagattataattatgtacgtattcttcttctaatacactaacaagtaatgcaatcttagctccttgtttgaagttgtgtaattttctcttctaatatgtcctttactttttctttatagcatgagatccaattgcttagtaggaagattgagcggttgtagattatactatgagagagagcttcaaaccaaaaaattctcctatttctcttcttccaaattgtccagcatacaattgtgaataaattgtcccaaacacggtcccagttagcaaggcaatgaaagtcactgaccttctctatgtctttcctttaagaagcctttttcaattgatcaattctcttgaggatccacttcagcaatttaaatgcagacatgtagcttgtcaaagatgaaagtacagagttgataagagccaatctatcttctcaagatagaaaattttctttccaaaaggccaatcttgtcatccaacattgttttgggagcttcttctcatatagcggtagtcttagataggtgattgggggaggacacttcttttgcaattcatcaatccaacaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattatgacattctgtggccatattatgacatcctacgatcaaattataactttctacacaggatattataatttttcttctagaagtcataaaaaaatgatatttttatccttaaaaacttataaaatttttaaatgacgaaaatatccatcccttctttataatatcctatggttattatgactttttacacaggaattcataatttgaccgcatgatatgataacatggctatagaatgtcataattttaacacaaaaaaaaagagatatttttatatttcaaaattttaaaagaaaaattaaactatagataaatgtacattgaaaagtgatggctatgtagcccaatcagatgggacgggatggtatatattttttatactaattgcggtgtacaaagaatttcccatctctattttctcaggaaacctcgaccccattttgtggattataacaattgttgattataaaattaattcttgtctttgcggatctctattttctcaggaaacctcgaccccattttgtcgattataacaattgttgattataaaattgattattgtctttgcggaaatgtcacgttgagtaagcgacagcgccttgccgtccagtttccgactactccaagtgcacacaatataatatgatgaattgatcctcccaagttggcatgacgatgaatcctttgtaattctagttgcaggaaattcttccaatcataagttataccaaatatgatggtaacgtatgcacaaactagaggcttaggttctcttgggggggttgaagaaaagagaaaagcttgtgactcacgacaaattcctgaacctttttttttggtagaacctgcagccaaaggctactcattcaaggattaaagttcagtatcagagtttacaggcctgagtacaatggttaagaagattacaccttacatcagacagcatacactacatgacttagggaacccaaccagcttaagaaaatgtactcaaacaaaatcgtgctatcagcataacccagctacatattcatccccagtaacttttgaacctggatttcagagagcaccattcaggatgcccaagtccagctatagttggcaggcacatcccacagatcggttgaatccgtagagcttcgcatatccactgttgttgtcgtttccaagctttgccactacggtctttctgcaaatttatagccagttcatgtggaataacatcattggcgccccaaaagcattctgtttgcttagccaatttggcatggagatgggcagctctatttgcttccctaagtacatgagagattaagaatatgtgacagtacttaagcttccaatacaatacatctattaacagtggcagactctgcgtatctcccaccttacaaatttctcactttgcgcattctctgccatcaatcttcttctggtcatgtccttctcctagtgcaagaagttacttaacaagcccttctgtaacagcttattctagcgatagaacctatttgatgtcaaaagagagaagagctaattcaatagcagcggagggatgcagattcagtggatcttccttgctctgattctattcttgataacctgaaaccaggaaagagccaacggggtgaaagaggtatataaaaatttggtgggagagacctctatgttcatcagcttaaatcattcaatgattgtttacaattctgtcatctatttgacatgagggctacaggacttggtcttggagttagcaatatcaaaaataacagataagagtctccttcaggcaaatataggcagcttttagttcaagtactgctacccaccgacccatccaggcagctacaagttcagcgtattgaataggacaatgatatatagatttctcactaactttagtcagatatccattagagttttgaattataaagcccaggatcactttgtcatttcttactgctgcatcaaaattgactttaagatatccagaagagggaagtgaccaagaaacagataaggatgaagaattgtccaattcaggtggagacaaaatcaccccagcgcctcgatggattcttagagccaagttgatcaccttcattgtcattaggcacaaagtaactagggattctatacagcaattgactaggggaaaaaattgcattctgaaaaattctgtcattgtggttctcccaacaacttctagaacccctgcctctcttgtataaaactcttccatcaataaaatagtggtggctgttttttcagcctcctttacagtcaaaaaaaaaaactgtcattgcggctattcgataacagccaagctgtgattgccatgactgatttccatctcccatcaacctcaatggcagaaaaaaattccaccaagccaggcagtgagaatggaatgatgtctattttaaaatagcttctaatgaggttccaacaatgtcctacaaatggacaatcaatcaaaacatgctgtatatgttcctctagacctgggcaaagatcacaacccattatgtcattgctagtgatacccctcatagctagaagactcctacaagggatgcattgccacatgactttccaccagaaaaatctgattcacaaaggtatctttgatgttcaaacccaacatgtattttggttcctgagggactgtctcccaaatgagagggtatatatctttaagtttaaaaccttgcccccatattaactgattagaacagttaatttgcccaaacggcactctactaatttgtttcatcatatcagctgacattagctgtcccaaaagataactattccattccagattagaagagagaagatcacacacttttgatgtctgatacttgggagtcaacattaacgtaagttggccatctagcaatagaaatcctatcaatccaaggatgattaactacacttacatcctttccattcccaattagccacataaagttgtattgtattaagaggccacaatcaaaaattttcccccagatggatgaacatttctttgatttagaatactcggcccatgaccctgaaattttatagttagctttgacaactctggaccacagggaattaggctgtagaataacttgatctgcaagcttgcacaaaagggctttttgcctgatgttccgaggtataatacccgaccctccccgttaaaccagccggcaaacattctcccatgcaagaaggtgtaagcctctttgatctgaaatatacccccaaaagaaggctctgtattgcttctccagtctatttaggatataaatagggacatgaatgcaagacagatagtatagaggaatagatgatagcactgatctaattaaggttgctctgccagccatagacaatgccttccataatattgccatcattttctcctcaacaaaagtaaaagcttctctattcaatagcctacctaaaagagaaacacccaaatatttccataatcttgtgtgttcattaacttcaaacatccttctaatttgagctttagttcttgttggagtagctggactaataagtggatgggatttattgagattaggagcttgcctagataaggaacgataggcatcaatgattgctttcaggcagcgcacatccttagcagtagctttagccaccaatagacaatcatctgcaaagaagatatgagatgctattagccctcctctagctggtttgtaaagccctctacagactaattttccacggcataatgaataaatcatgacaggacttcagagcataaaataaacgagggaaaagaggacaaccttgtcggagtcccctatagatggttgaaaccattgcattggggaaccattcaacaataacgcaaaggtagaatccactgtacacgcccgtatccaagctacaaacctaaaatgaattctgaattgcttaagcacttgaaataagaacggtcaatgcacatggtcgtatgctttttccatatccatcttgatagccacatgtacttctcataggagatgctttatctaacaaatgcatcatctcttgagctaataatatattctcagttatacttttcccttttatgaaagccccctattcatccgcaaccaacgaagcctgtagaggctgcatccttttggctaaaattttagccacaattttataagttgtattacaagagcttataggcctgtaggcagccggttgttgggacagtctttcttaggaataagagttataaatgtcctattccaatcttttggcattgtcgaacgattgaagaaatattgtacagcttgaataactttcttcttgattctataccaaaatacttgaaagaaaaaagtgggtaaccatctcggctcggagctttgtctgggtgcatactcttaatagttttcttctattttctcttctgaaactggtctaattaatgtattgttttgagcatcagaaacctcatggccaattaccagaatattcatttcttctatatgctgctgtctggtccatcttattgaaaatgttccacaagcattctgcccacctcttctgttttgtattagactttcttgttcatcttgcatcatcaaaattctattcctctttctcatactggtagttgatctatgaaaatatctagtattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttcccttcaagaggtgccttttgggccgaaggcccagagggatcctatatcagataatgaatcagagacaccttgccttataaggtttggaggctctcctctctctcaagaggcaccttttgggccgaaggcccagaggggtcctatattagataatgagtcagggatacctcgctttataagatttggaggctctcctccccctcaagaggtgccttttgggccgaaggcccagaggggtaaagctgtgaggcccggctatcgaaggtgaatccgtccggttaaaatatcagtgccagagcggacaatatcttttattcgggagagagccgaatccgacctcatgaggccggggttaccccgatcacaacatctagcattctcatccccttgctttaaccacgcggctcttaatatttgtttccatagaagttcttgcagttgaagggttttgttatacttactcaacaatgacaggagctggttatgagcttgatcattgagacctccatattgagcctcccgcattcgaaggatacagatcttttcatttaactgctgagtattagtaaaaatattcccaatccgttgcttccatctgaagatagctttcctgattttgcttaataatgctgatcatttaacacgtgatgaataatttccatggcaatgccatgcttgcggcacgtcttcatgaatcccctcacggtgctgtatcttctcaaatctaaagggggtttagatctttcaactccattacttcaagaaagtaagattggacaatggtttgaagcaaaccttgtcagatgctgcacgatactctggaaacatggacaagcgctactcgatcacaaaagccctatccaatcatacccaaagtctagctaggcccaacctgttgttacatcaagtgattcaggtccttagaagtccagatcaatgaaccctgttcgcctaataaaaactctaaactccctaatctccctattcacatggaatagctgaccccttttcttatctgtattttgcaaaatacaattgaagtctccaatcaacaccatagggagttctagtgacaatataacctcagtttctatccataattttctatactctagttcagatgtgctagcatacacaacacctaatttctatcgttgcttgtggtccactgaaataaccccatgtgcaacttgtctgtcattatgaatgaaatttatataatttcctacagtttttctccaggcaacaacaattcatcccgactgaccctgtgtcggaatcatataagaatcccactagggccccagcaacctcctgatccaaggccaaaccaatttatctagtcttgtctttggaaaacaacgcgtatctagattaaattgtctaatcaaagttgtaatgtagtttgcaaaagaaggcttggaagcccctctacaatttcatgataatatttttattaaaaattaaacataaatgcagctgattctccattcaaattttagatttaaagattattgagaaaaaatttctcacttaaattgaagatatggattaacagaaaagcagatgatatgatatgcaatatcgatgtcacagcacaatcatgaatgaaaatgtgtgattctaaaataatatgtttcttctgtactgtatgagaattatctgaaatcatccaatacataatccgagacctcctggccctagcttcggcctctgacgatccttgacttctaatgatcatcctaagcaaaatactcaggatcagtcgatcctgacttcggccgcatcttgacttcggcctcaagcctgactcagttttcatgacggccgacatccgacaactatccaatatttgtagatgatcggatagctgaattagccgattttttatttcagctataggtatactttaatcttcactacttttatcttactgaacgtagttagttctagccgcttcttcccttcggcatctacttccatcggaccatgctgaagcctccacaaatgaaactagtccaatcctaccaacacctctatttcaaaattcaaaagtgcttgcgacattagctggtttcggaatagataaggtaggtgtaactatccaatcttataaatttcaatcaaaaatctcaccatatcgcatctaaatcggccacataacctacccaaaatggtctttcaacctttgtctataaaaagacctctaggagacatccaagatacatccgaacaatctctctacactctttctcacctattctcttgatttctgacttgaacattggaggattctcatcggagcaaactctggctaagacttgccttgcaggattctctaccaaaggatgcgccaccgctctagctttttcgatcgagttccaaattttaatggcaacagattgccatccggagacttcggccttacttctaggcacatcctatcatggtgctgacaaatcaagcactcaagatagtcctgcatcgacttgatacttctggatgattggcaaactggccaatccagcttgctgagttcggggtgaaatttcagccctagtcttctatcaaagcctaaattttggcaaacttcaccgttgaatgcaccatttcgaacgattaagagacaccagaactgacttaggaaggaggtgcattggtggaacccagttcatcaggaggatcggatgacttttgggtggtgcatgtggatgattcatcaaactccatggggtcaggagtgggcctactgcttctcagaccagaagaggctatcgtggaatatgccttggggcttgacttctcggcaaccaacaatgaagccgaatatgaagctcttattgtcagactcaaaattatgagggaactcagggtgaagaagctgaggatctgcactaattcacaactagtggtcgaataagtaaagggagacttcaaagttcgagagaaaaatataaagaagtatctctaaaatgcgaaagatctggcttcgacattcaacaggtaccccgattcgaaaattaattcaagagctgatctactgtccaagctagtaacatcgacctcaaaagatttaccttagaagatactttttgagatcctaaagaagccaagtgttgaagaactgatcccgatccaatagattgaggataagccttattggatggatcccttcatccattttctgcaagatgaagtattgcctgcagactctaaggaggcccaaaagatcaaatatcaagctctccgctatgtcttctatgaagataaccttacaaacgatccttctccctaccacttctcaggtgccttcatccctctgaagctaagtacgccctttgagaagtacataaaggagtatgtggggtcatttagatggcaaatcattggcctacaagattcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagatcccgatgtaggatctggtgtggtgctctcaaggctcaggggatcaaggaaaaggtcaagttttaaagcccatgaggcattcatggaagttctagggctagtttgggccctagggtgaaaggctgtctgccttcacagttttgaagtctagaagatttgagccttgagggtctaatttgtattgaactaggtttgagtctaagagaggtgagattgggtcaagtcatgggtgtatatgggcttgagtaagctcaatctcatattgagttaaccatggaagttttttgggttggatcacattgatcttatatataaagatatattgtaattcggtttgactaagcaaatcaatacaagctcttttctccatgaactttctctctcctcatctctctctctggtgtggagaaatcctagccaccatctagggttgaagaaggaagcccaagcctagccgccccatcatacttctcctagttcgagtaggagaaggtccttgccgcccataatatgattttctggttgttctaggactttgggatgcccaaactgccagaataattgctactcctaatctccttgcttctctagaagttgagataggcatccctaagtaatcttaaaaggattggaaagcagatcaaagggatctataagaaggctactgtccagaattctctacagcaactccctcgtgtttcaacacctccacagcatccaaaagggatctccatgcttcttttctctactggttagaggctttatttagggagcttccatatctgaaaaggagggttttagatctgaaagagataggatttgaaagagacaagaaattctatcaacaatcttctacaagttgctgaaatactaaaggctgattttgatttagagatttattggccatcaaagacctccaacggccccttgttgctggttccaagatcaccacttgagaggaaaaattttcaacatctggtattagagctttggagttctattgggtggaggaaagatcaaagtttcgtttggatcttggtaaggtgctgaacagattttgtattgaacaactttcttgtttgttggtgtttatttgttgagatccatatgggatggcatctagtagcattaaggtggactttgaaaaatttgatggcaaagaaaacttcaacctttggcagcaaagaatgaaggatctgttagtttagaataggatctataaggtcttggttcagaaagatcgaaaaagatcaatatagaagactgggaggagttagttgggatagcttttagcaccattaggatgtacttagctaatcagattctacctaaggtttgtactgaagccatgatgaagggactctaggagaggttagagaatacttatataggcaaaaatatgacaaataagttgtggttgaagaagcagttgtacagcttgaggatgcccaaaggaggagacttgattgctcatatccagaagttcaacaagtttggtcagatgttatgagccttgatgtgaggatagatgaggaggataagactctcctactattgtgttcacttccagtttcatatgatggtctcattacaaccctggtgtatgggaaagagaccttaaactttgaggaggtggttggagttctcaggtcaaatgagcagcagaaaaagctatgtaaagagagttcgaatttagaggtctttactgtaaataagaggcaaggtaggcctaaggagagggctcgagataagtcaaaaggcaaatcaaagttttgaaacaatcagaaggcctgaaagtactacaagtatcatcagcctgatcatctgaagagaaattacccacttctgaagaatgagaagggaaagggctcttccaagggtatttcgatcaataggagtggtgcacactcatctgagaatagtggagatgatttactggttgtatcaaatagaaccactgagtatgatagccattggacactagatttatcatgtttccaccactacactgcatatcaggagtggtttgcttcttatgagaaatctgattgaggaagtgtgagccttggagatgatcatccatgtagggttgctagtgttagtattattaggatgaggatgtatgatagagttataaggacactcaccaatgtcaagcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggagagtatttacatggagcaaccatcagggttcaaagagcctgggttagaggaggaggtctgtttgctgaagaaattgttgtacaagttgaaacaatcgccaagatagtggtgtaagcgatttgacacttttgtgaggagcattgaacttttcatgtgtgaatatgatccatgtgtgcatgttaagtctctgaaagatgggtccggggtatacttactcttgtatatgaatgatatgctgatagcatgcaagagtaagagggttgtgtaagaattaaagacagccttatctcaggagtttgagataaaggacttgaggcctgcaaaaaagatcctaagcatggggatcaatagagatagagccaaggggctgctgtatttgtctcagagagattacatacgaaagatcttagagagatttgggatgaaggaagccaaactgacagcactgttaattgccaggcacattagccttttgaagactatgtcgtcacagactgaggtggaggtttagaagataaagagagtgccatatacctctaatacgaggagcataatgtacaccatgatatgttataggctagatttagcctacgcagtgagtcaggttagtaggttcatggaacagcctgatggggagtactgacaagcactgaaggaaattttcagatacttggaggattcagttggagtcagcatctactacgaatagcaaggaagcactgagggacactctaacatatccaaggaggttcaggggtagatagaatggtttgtggatgcggattttagtagagacgtggacatccgatattcgacgacaggatttatattcagtttgaacagaggtcccatttcatggagatcttgcttgtagcccataacgactttatccaccattgaggtagagtatattggcatcacaaagatagtgaaggaggctctgtggctaagggacttagtgttggagatgggcttctcatagaaaatcttcaagatgtactatgacaaccagagtgcactattatttgcatagaactccatctattatgtgaggatgaagaacatcaacattagataccatcgaatcagagagattatggaagaaggtgaggtggaactgatgaaggttcacactaaaaaaaatctagctgatgcattgatgaaggtacttccgtgggacatctttcacaaatgtgtgtcactgatgggattgatgtacaggataaaatttgttgaggccttgggacaccaagatagagattgtagaatttgatatggtgctcccaaagctcaggagatcaaggaaaaggccaacgttcaaagcccatgaggcgttcatggtggttcttgggctagtttggatcctagggtgaaaggctgttaacctttacagtttcaaggtccaggagatttagactttgaggggctaacttatattgggctaggtttgagtccaagagaggtgagattgggtcaagtcatgggtgtacatgggcttggatgagcataatctcacactaagtttgccatgggagttttatgggttgggtcatgttgatcctgtatataaagatacattgtaattcggtttgactaagaaaatcgatacaagctcttttctccctaaactttctctcttctcatctctctatctctaattgctgaccttttaagtatggaaaaatcctagccaccatctagggttgaaggaggaagcccaagcctagccaccccatcatacttctcctagtttgagtaggagaaggtccttgctgcccataacttgattccctggttgttttaggactttgggatgtccaaaccaccagaataattgttactcctgatctctttgcttctctaaaagttgagatagacattcctaagcaatattaaaaggattgagaagaagatcaaagggatctataagaaggctgctgcccagaattttctgcagcaactcccttatgtttcaatacctctatagcatccaagagggatctccacacccctttcctttgctggttagaggtttcatcaaggaagcttccagatctgaaaagaagagttttagatctgaaagagaaaaggtttaaaagagagaagaaatcctgtcaacaatcttctacaagttgctgaaatcttgaaggctgattttgatttagagatttgctggctatcaaagacctccacgactccttgttgttggttccaagatcaccacctgagagaaaaagttttcaatatttggatgattgagaagcgaagattaacctagaaggactttcggagggctaacctacaatgaccctcaacccaccaacttcgacaataagcgaagactaatctaaaaggtccttcggagggctaacctataaggatcctcaacctaccaactttggcaacaagcgaatgctaacctaaaaggaccttcggagggttaacctacaaggatcctcaataacttcgataatatatgaggctaaactcaaaaagatggtcgctttacgggcatctctatgagatctctcaacgcaaggatcatatgcggattaaattcgaactatagcacaatcaacaaggcacagtgaacataggtaaaataaaaatttcaaatctcatttttattaatgaacttttgataaaagttgcaaaacggacgtctataaaaaagagaggaacaaaaaaatacatctatcattgactatcatttgaaggatccacattcgatcgatgaaacctcaatgttcccaccatctttatagatctcaagatgagagttgacttcataaaaaagttgcctggccaaactttggcattcctcgaagccaatgtcaattgattgggctaatatatcggcgaccacaatagttgcatcacacaaagtcgaagcaagctgatcttctaatagcctaacagtggccttagcgtgtttagccgtcattgtatttttcgtaaattggattcggagttcaataactgtagatctatctttgtttagagctcctgatagatcagtaattatttttctagccaagataagctcgctctggatattatcgactgctgacctcatcatgtccattgcctgatgaagtttcctaatcgtacctttgattgagtgaagatcatcttgaagtcggctaatctgcttcttagcttcatcaccaactttgtccgatgtaataatatgcttcaacttgaatatttcatcttgggccctatatacttgctcgttgcaaagaacttttgccacccctatcctccagttagcatccccagcagacttcgcaaatttatcacgctctttaattaatctatattttgcggcaaaatattttctatctgtctatttcagatacctcctcaaatgctctacttctgtcgaagactcatcactattcttcttcaccttttagagcttcttttttgcttcgacagcatcctgttaagcctgatagaggttctcctgaagattcttaacttgaacccttaaaggcaaagatgttggcatatgcttgacacgatattgtacaatcgtataattgtaacaatcacatcgaacctactgagaaaagcatcacaaatagatatgaaccaaagaatatgagcaaaagttactttttcattaactttaaaattttccattacattgacaagaaaagaaaaagaaaaagatatacgagtttaaatatttccgatcctggcatgaggatcggtggaggagctagagataactacagctggttgcttcgactccacttgtggtggcgaaattggtgcaacttcggcagaaacggatgcaggcaccacctttgggggtggagcagcttcagagctctttttgacagtcttggccactgaagctccatcttctgcaacttcttcctcggttcctccttctttttcttcctcttctatgttatccagaagctcaaatctacgttcgaaaagtgcacagctaccctccgatagcagatgtccaagtcggtgttgaaggcctcctggctaaagtcacatttctctttcaaaaactcattgaatgcatggaaggcttccacagccatgcatttggctttggcaacctgatccttggtcttcttctcaacatcaacagttttggcttccacagccgtgcgcctgactttagcaacctgatcttcaaccttctctcaacattgacaattttggcttgcatctctagcttcctttccttctctaaggccaaattggcttcgactttctttagcaccatcttcagatgagtggcctccacccttgacttgacttcgacttcagaagtttcgatcatattgtactttttatgcgcttcgatcaatttttccttagcatcacatatcttatttatgaggacagcagcatagtgacctgcttgtacccatagagcaagaggtcaaaaaaatgaaaagggagaagaaggaaaaagaaaagggagggagaaataaggatgaatttatccatactatggaggaaaccatcagcttttcccttcaaccttttttaggctgacatcaaaaagcatcctccgaaagatactatgggtagtcttccaacattgaagatgtcttaagaggatgatgatcctgaaccctatctttggtccattgatcccctgctgagtctaatcccacctgggttaaattgatctggagggcagggagcgtaactagcttcgagggtcgagtttgaaagggagaaaccaaaatagctccctcctaagataaagtcggggggaccactttcttgttactctcatctgaagtcttggacttttcctaaccatcagtggatgaagagggtgctttcctcttcaacgaacctctcatcagtctcttcactttttcaggctttatttcttaataaaggagtcagcatctataaaaatgagaagaacgagcatcaaaaaaattgaagaaatcctcacctttggggttgatcgaactgatgccagcattgaattgtgcttactccgataacaactcctttaatgaaaaaatttcgtatttccttaaggttgtagagcactgtaattctccatcttcaagcctcaaaatttgaaaaacaaaatccctcggtcgatcttagtgtagaatctccactactttataaaaggatctgaaataaaaaagaaccaatccttccagccatgcattgaagaaggagcttctcttatcaaagtggagaccccctcggaggagagatgtactatcaatcatcggtacatctctttatggtgtagaaagatcgaaaaagagaaagagaaggctagactccagctttagaacagagaacaagaaaggcgataatgaaatgaaagaagttagggatgacagaacaaaggaaaagataaaaaaagtagaagagctcaacaacaaagagatggataggaagcctaagtccgactttgaaagccttttcatatagatcgttcttactaggtggactattgactctaccactcagcctaaaagattctaattcgaaggcggttgggatcctgtactggacatggatacgactcaagtcttctatgcccaatctagatccaattatgtcagaaacgaagggaggtgcaacactacgcccttctcccacatcgacaggagttttccacgaagaggaagatgatttgaaaatcaattctcgctaagactcccagaagttgccattagaagcacaaaaaaaaagaaggtgatcggactaaagaaactaaaaaaaaagaggagaaaggagaccaactttcagcaacatgacacagaagatgagggtgatgattctgcaaaaaataagggtggcaatccaaagaggagctgttggggatcgagaaagctcttggaacaggaaagagaactagaggtaaaaaagaaataggcccggaagagtccaaaaatgcgaaagaagaaggcagaaaatacaacttccttatataggtgcagaagatcaaagccatccgaatatcaattcctgtccaaccgtctgatgactgacttttggcatgattctattggcatgcgagatgtcaatcagctcattaatgatttgtgtgggaaataaggcatatcactttttgaattccaccaaccgcctttcgatcatgattactcactgatatgaccatttgttccacccaagaaccacaagcatcatttcgataggaaggacggtatgtctttgataaatctgaactcatgtactcccttcatccatactgaactcttgagtaaggggcatgtgttggaagaaaatttatcatttactcacttaggccgaagacatggactaacagaagagcagatgatatgatatacacggttgatgtcacagcgcagtcaaaaataaaaatgtgtgatctcgaaagaatatattttttctgtaccatataaaaattatttgaagtcaaccaatgcataacccgagacctcttgatcctagcttcggcccttgacgatccatggcttccttgacttctagtaatcgtcctaagcaaaacactcaggaccagtcgatcctgacttcggtcgcatcctaacttcggcctcaagtctattttagtctccatgacggtcgacatccgacatctgtagatgatcggatagctgagttggttgatctcttacttcaatcataggtatagttctgccttcatcactttttgttgaaaaatatatcctaaaatcaattatctattcgtagtcgattgtgctctttgtaatttgtatatgtattattaataaataaaaattatttttgataagttcatcataaatgtgtatttttctttgaactcttgtattatgatgaagtctttagaactataatataattgataaaggaggatttatcaaatagttcttaaacttatttatgatcaaatataattattaacaagaataataatatttatcgagtataggtcattgtgcctcatatggattggttatcctcttaaccaaagagtgtagagatactgatatggcatacagatataatgtaggagtatattattaccgaacagtgactcacctatggggcattctgctattaaggatagcttgtgaagcatatggatataagtatcccatcaatctaagatcactatggtgacttgtaagcaactcactatgctttgatgtcagattatctgtatttttaatatagtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatctagacgtcagatattattgctaaatgatcacttcaaatagtatagaaaatagtttctatactatcgatttagtgtttgaacctatggagtcacacataaagtcaagcaatgtaagaaagaattgacctagtatctattttgaagtatgagacttgattgaataaatagatttacttaattgagaattaagttatagatcatataaaattaaacactgactatatctagctagcactggacatgaggtgcagatttaatttcggagatgaatttgacctaatctatgatccaaaggattttgagagattggattcaagtcttagttattttagattagatctgatttaattaaggctaattgggttagttatttaagttgaatttggatttgaatcttaattagattaggattaacaatcttttagaatttgattcgaattagattcgaattgaatgcaaatctgaatcaaattggatttggtatactaagctatgcttccttgggactctctctcttttgggctgaccaaggaagtggtggggcactagttttcatgctccaaccccttgtgcgtgcgtgataagatggggggagcaaggtggcacctctccttctgcctttgggactcctcatagattagaaaaatttggatttgattcaaatttgtagagtcctaatccatgaagagtatgattagggtttgggcatccaaatctatttaagaaggggcatggaaaggggtagaggtagattattcttgggtgtgagcacctcctaggcgcaagacctcctaagcatgtgcacctcttggcgtgatcccctcttggtgtagagttttttctttcagacgtgatcaagccttctctagcctccctcacattgagaacagatctcaaggctctcccttgcttcccttctgaaggagtgatgcttgagtcttcatccctcactcctacgatgcctgacatgcatacgaagtagaggatctacgtgtctagatctcgcgaagtaacgatcttcaggaatcaatcaatcttaatcatttttttactatgcatcaagataattttcataagagttatgaaaaattttaaatttaaaatctattctctttcttcatggcattcgatctgatcggatattttttcttcaactggtatcaagactaggttgaagatatgagtgcataaaaatatttttttgttattttttgatctggtatgtaaccaaatttttttagataagatctaatcaggtttcaacctaattataagatttttttctgatttagttttgatcagatttttggattaaattagcccctgaacctgacctattaaaaatctattttaatagaatttttttcatagatttttctgtttaacttaggatctgattataacctgatttaaatatattttgaatagatttttgtggatgatttttagtcatgaaatttatatttaatcaggttcatatctgaatctattttgatagattttcagatctgattttggacagatctctacagttgttttgatttccatctaactagaatttttctatgcattcatatcaattttttgaatagatttctatgctattttagatctaaattagatggtttatatgctgtacaaattttaggttcaaatctgaaataattgtgatgttatgtaatgatctaattagattagataaaaattctacatgctgttatgttatgaatatgatttgaatcatttttttttcttttacatatatgatatatagtgtaaaattattcttagtagccaagtattcagattgagttgatcaccatagttgtccgatcataagaggaagcaaggattaaaatccttctcttatccaatcgatgggctctcttatagcatgtagaggtgccgctgtgattagatctcttgaagaagaacagcgaaaatttttttttaaaattattttaattataaatatatttaaattagatctaaaagatttatgattaattttgttagatttatgcaaaatattcagatattaaaataagttttattatctaaaaaattagtgacatatgatgtaagttttgtataattttttttttataaaatagttttacaaattaaaatagtttcaatatagaattttatatacttaattgagaattaagatataaaaattaaaagatttagatttgagaattgaagatcttaagatacctcataaatcaaggagctataggatagcttgaatcaggttatttaaatgggttagacctagggttagaatcgaatttggactaaattgagaaatagattaaatctaatcaagttttgaattagattaggtcaagatttctttagatcaagctcaatagttgtagctggatcaaagtctattttctgattttatcaaatggatctgatcgtggctcagtggttagggcttggatcaataggctgatctgatcaatttttgttgaccaattagtatctaaggtaagtttgacaattcgactgatgatttttaattgacaacctatttatctagccattttgatggtgtctaagacaagccttgacagaccctcccaccgatctcacttatctgactaacttgatcaattaagttttaaattaggttgcctgatgatttaagctaacccatggcattaaggttaatcagtatggttaatttacatatctttggaccagcttgttcttaatcctctttgatggcttggtgaagtcagtgggagaatttttgaattgctggttaatttcttttcttgactctaaaatatataattaatttttttaaattattagatccttaaaatgataatattaaagggttagcaagttgataaccttccattaagatggatggtaatgagtccaatagtcttgttaagcattggaagtgccacactcatggtgtttatctgactattgaaattatcattcattatatgatgacgcagatatgactttctagtgggtggttaggttggtcgagccacactcgagtctaatcattcatttgttagatacactgagtatgatcatattaatagttggatctaatcaggactttcagtggagacgccacacgcttgctgaagagaagcttggggcaaaattattacaaaaagttatttggagaagcaattggttgagaatccacccataaatgcatatggattggtcgagccacactcgaacctgtgtatagtttatgtggattctagtacctgctaagaaattaacctaatttctcaaattaaaggtagagactaccaatttgtataaaatagtgagagaacctttatactagagtccagatctttaggattaaataattcatatactaatagactttatgttttctttcatgtagtaatggctaatactttattgctccacttgctgctggatagcgacaagctcaccggatccaacttcaatagctggtatcgcaagttgaagatcattctggagcataagaggatcctatatgtgattatagatcttctacctgaggagcctgccccaaatgctcgtggtgtgatagagacacttatcagaagtggctcaatgaccgaaccactatgtattgtattatgcaggtggctatgtatgatgagttcagtcgtaaatttgaggctgcttagccagaggagatgcttcaaaagttgaacgaatcctttggaacccttgaggatgaagagaggcataaaactttttatgcaatcttcaatgctcagatgagggaagggacatcgatcatgattatgtactgtacataatcgagcagatcgagtgcctgagcaaactcaaattttttttgcatgagcagttaggaaaagatgcaatcatgaattctttgcacaagtcctacctaccctttcttagtcattatagaatgactaagcccgcactaaactaccagtttgctagaattactacagacctttgaaaaggatcaccagctttacaaagagccagtgaatatggtggtctctcttctggacgtcatctctttaaaaaaggaaagaagaagaataagaagaaggtgcaacgtgctgggctgtttaagtctaatcagacccagaatctcaaagcagactagagttaggcagagtacttcttacgtaagaagctggatcattaaaagagaaattatcctcagtatcttgcctcccttgacccaaacaggcttaagaagagaaagtagcaaggagttgctggtcagcataattatatgataacaccttataatttttctatctgtgatactactatctagatattggatattaaaaatttaattaatatttataatttattgcaagaactttaggttagtaaaaaatttgaagccgacgaaaggttcttgaatgttggagatggaagtcatgttctagttctagcattaggaattgtccatcttgtcttcgattctgaaattgttattttgaatgagtgtcattattatccttcgttccttatgaacattatttctgtaggccttttggccaaagatgattttaacttttaataaagaaaaattattgtgatatcattatgaatgatgttactgtaatacgtggataattgagaaataatatttatatattatcatgacctgtaactgtaatgtacacatctaatatatgtcctaagatagataatatcagtgatgcctacttttgacattgtcggctaggtcatgtgaacaagaacatgatagataggttaactaaaaagaaaatcttcgacattaacgattatgaatcattatcgatttgtaaatcctatcttcttggtaagatgacaaagtcatcttttaaaagaaaagctgagcgagccattgatgttctgagtttagtacatagtgatgtatatggacccatgaatacaagtaccaaagatggattcaactacttcattactttcactaataacctatcgaggtatggatacatctaccttatgaaacataagtttgaatcatttgaaatgttcaaacgattccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatatatatatatatatatatatatatatatatcataaactatttcctatcagtccataactcataaaaaatcttttgaactattttagcaaaaatcttatttaagatatgcatagttatctttatagccttattccataagtaaataggtctaataaaataacttatcataatgcaaaccacttctttaagttattctttctttttgtcacactattttgatctagcgtgctttaacattatgtaatacaatgccatgttcttttagaaattttgcaaatggtcctgatatttgttccatttcaatatgttttcatattacttgtcacctttattgaatctgactactttaattattttttctgattgtctctctatctctatttctaattttttaaagttttcaaaaatatcagctttatcaaatttaaagtatagatacatatacaacgaatagtgatagtgtgacaaaatatttgtcacctcttagatatgaaaaaaaatatttgtgtataatagtgtgaatgatttctaaaatttttttaatcaacctaatattcttcttaaatgtgtatgtctgctttatcttgatgcaatcaatacatgttacaaaaatagtgaagtttaatgatcctaatattctatccttcattagctttataactctttctttggagatatgccctactccttgatgtcataatatagaagagtttttaaaataaaaatctactccacaatcgaagactattctatagcatccaactatcttaataaatgaatatgcttaattttcaatgagaatagaccattcactttcaattagtgccttcttaatagaaagtcctataaattgttggcaatgtgcataaatgcactagagtcagtgcactagatagaattaggaacatttactaaattagatttaaggcacactcaaaagtaaaaggtatttttttttgcaactatcttttatacttcatgcagttttctttaagtggcccatccttttgtagaaaaagtatttgacaatcttattaatggcttcatctaatatcacaacaaatacttattaggatctaggtaattctaagcatgctgaatttcaaatttttttcaaaacaaaggcagtggaagactagattaaactctttaatctaagcatacaatgatcatatcataacacttattttatgccataaaaataaatagatagatttgacatcagaaaataaaataagaggtaatcagattacttacttaattcatagaactccttctcgaatctggatctacggatacctttagcaagtttcattttagccgcacaagcgtctgatctctacggatatccatacgaggcctgacctgattggaggctttttgttctctctgagatgctagctcccttgcagagaatattttgttgatggttggattggatattcttcaatctataagactctcttaagaaagaagaagacaaggtggatgaagaagacaaaacaagagaacctttctcccttttctcttctaaaacctaatgcccacaagagccccacacccctctaggaaagctcatgccgctctctgatttttcacagtaaatgtcagattttaaaatcctctcacacaccccataaaatcccttttaatagacatccaagaatttggttgagattgggttttgactaggtcaaacctaatcaagaaaggtttcatgtttgaatctaattcaaactttaaacttatcccaatcttaagagaggaagggtgggtgtgggctccaattggcatggcttttctttcacgtaaaaccagaattcacatggagaatttgggcgttaaaccttaaggcgtggagatggagtgggcagccaagaacaagatgaatcccagatcaactgggaatttcttgatttttgatttaatccttaactaattttgggtccaatcttaactaacttaagaattaattataactaattaactaattaggtcttagtccaattaggaatccaattagatcctaatccaattagaaaattagttaggttaaaccccatcaaattagagattgatttcttggacaattggattatctcataatccaataggcttgatccgatcaaacccaaatcaaatccaatcgaattcatttttgaatagatttaattccaaccccattgctcaatcaaattgagccctattataatctaattacaaattaaatcctccataatatctaatctactagtggcggctagcagcatgtggtgatagtccagcaaaatagaaagtagaacctcttggtgtagttaccatataatttagtttttttatcgtgagtctcgataagatggaggtcatgaaaactcatcaaactccatcatatgttatataaaaaattcgatcagctcgagtcaaaattatgaaacttatggaaacttctttccattaatcaccttgcagtagccactgacttaaggactcagcttctcaaatttcataggactgctctgtatctactaaggttgatagatctcctataagtacataccttactcctacagcgaatctactgtagccaacgaacatcataagacctcgaatgactaaggaccatgtttatgtattgtcaaactacagcaatctcaccatgagtagtcgaggcaccataagtcaaagaaccactcgtactactacagcatcgagaaggtcatggacgagtgagtagacatccatgtgatctttcgtacaatcatgctcagtaacaatgttctctaacatccacctgcactctcgtccaatatccttatattgtaaactagagactcgtctatccaaaggaggtgatccatacattaatctattcaaatcgatcaccatctccgtgatgatccatcgatcaggagtaatttaagaattaattatacacgtttctaaatctcaacacttgaaaattttatatctttcaattattaatttcttagatgatttaagcacacattacgcaagaataaaaataataactacccattttattaataaataataagttaatgacaaatttatgtcctgaaagaatgcaatgtgttagccaacttgacttttcagatcatacatctaacaatctctcacttgatctaaagtcaattgattgtatacctaagacccatcttctcaaggtgtgcttcagtcttctgttggctgagaggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagtcatatgattgatttgattagcttaagttcaattattattctcataaaaaaaattttctatcaatcacaatactacagacacggactcacgaacttagcctctcaaatttcatgaaactactcttttctatcaagatcgatagattctatctagatgcgcatcttactcctatagtagaccaactgtcgccaatatccattacaaagattcaaagagaccatatttctgtgttagttaaactccagcagtctcaatgtaagtaaccatgccatcgcagaccaaaggatcatttacacaaccacagcatcgagacgatcactgacgattgactagaaatttatgtgatctctcttgtggtcacgctcagtactagttattctctaataactactcatacttgtcgctcagtgtctctacactatagactagagactcatctatcccgaaagaagtgatctgtacattggtctattcaaatcgatcattatcctcatgatgatactatgatcaggagcaatttagaaattaattatacatacctctaattctcaacaccttgagaaaatatatcgtaagtattaattttatggacgattcaaggacacatcacacttaaataaaaataaacttattcttttgttgatcaaatcaatattttaagtataaaattatgccctagtgttattacaatatgtcagccatattgacttttagaacatatatccaacaatctttcacttggattaaaatcaattggccactaatctaagttctatcttctcaagatagactttcatctttagctggctctattgctttatcagtggatctattatattgtctacagagtcgactcttcatacctcaacatatttttttttgaggtagtcacatatgatgtggaatcactgctcgatgtacttgaattttttatgagatcttggctctttagcaagtactatggctccattattgtcataatacagtggtatgatatttgatgtcattacctcaagctccacaataaattttttaaaccagaagccttcctttgttacatctgaagcaacaacatatttagcttctatggtcaaatccgcaatgatggattgcttggaactctttcagctgactgcatcaccattgtatacgaatacataccctgacgtagactttctatcatcaggatcagatataaagtttgaatcaaaatatccctcgatccgtaagtcaaacccttctccaaagctcaagaataaaatcttagttcctctcaagtacttaaggatgttctttacagctatccagtgcttctcgtctagattcgattgatacttgctcgtgacactcacagcaaagacaatatcaggtcgtgtacatagcctgacatacataaagcttcctacgatcgaggcataaggaatcttactcatgcgctgagcttcctcagatgtggtcggacatattgtcttggaaagacgaataccatgcttaaggggtagaaatctccttttagagttttttatgctgaacctcttcagcactttctctatgtacaacttttatgatagacctagcatcctcttagatctatccctatagaccttaatttcaaaaatataggatgcttctcctaaatctttcatggagaatttcttgaacaaccatcttttgactgaaatcagcataaaaatatcattttcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgattcacaatcttaggtcgggggtgtgacatcaactgtcatcaatatccactacaaggactcaaagagatcatatttctgtatcagtcaaactccagcagtctcactatgagaaatcatatcattgcagatcaaaggattattcacacaactatagcattgaaacgatcattgatgattgagtaaaaatctatgtgatctctcatgtggtcatgctcagtactaattattctctaacaactactcgcacttgtcgctcagtagctctacactgtagaccagagacttatctattctgaaggaagtgatctgtatatcaatctatcaagatcgattatcattctcatgatgatactatgattgagagtaatttaagaattaattatacctacttctaattttcaataccttgagaatatatatcgtaagtattaatttcttggatgacttaaggacacatcactcttgaataaaagtaatttatctttttattgatcaaattaatattttaaatataaaattatatcctagtgttattacaatatgtcagctatattagcttctaggtcatacatccaacagatctttgcagcttgcagattttgtgatcttcatcactgaaagtgaaccccaaaagctgctctgtatagatatcttcctcaaaatattcatttagaaatattatttttacatccatctaccatatctcatactcatagtaagctgtaacagcaagcagtgtacagatggacttaagcatggccacaagcgaaaagatatcctgatagttaatgccttcgcactgactataatctttcattacgaacctagctttttaggtctctacctttccatctacaccaatcttccttttgtagatctatttacacctaataggtactatactctcaggtagatccattaagatctagacttgatttgagtgcatcgattcaatttctgacttcatagtacttaaccacttctcaaaattgatatcagacatcgcctcgctatagattttggggtcatcttcatgatccctatctcctacaagaaaaattttctctacattctttataacaatacataagtaccttttcggaggatggagatcctatcagatctatgagatggaggagatacaacttctattggctcaatgttaacaggatcatcaattcatcgctctctagagattttctcttcgagctcaatcaaccttccactgccaccatcctagataaactgattttttaagaatgtggcatgacaactcataatcacattataatcctctgaaaagtagaaaagtatcctaatgactctttaagatatcctataaagtgagcttttacagatctagcctctaacttgtccaccatttatcttttgacatagactggatatctctaaatcctaaggtgactcaggctcgatttcttaccatgccatatctcgtatgtagtaggaacgaatttagagaaaatcttatttaatcaataaattaaagttagcaagacatgtccccaaataaataagggtaaatcagtgtagcttatcatggatcagaccatatctaatagaaacttatttttttctttgatatcctgttgagttgaggtgtaccaggaggagtccactgagagactatgttattttttttgagataacctagaaactatctactaaagtatttttctctccgatctgattgaagaatcttaagagatttttttatttatttttctacctcatgtctgaatattttttgaacctttcgaaggcttcagacttgtatctcataagaaatacatacccattccgtgacatatcattagtaaagattatgaagtattgataatcatccttggttggcacatcaaatgggctacacacatcagtgtgtactaggacaagtaagttagtggccctatctccatatctcacaaaggataacttgatcattttttttaagacaggactcacagattgggtatgattcaaacctcactgagtcaaggatcccatcctttttcagtcggtttatcctatcttctccaatatggccaagtctaaagtgccacaaatacttatggttcaggtcatctctaggtctttagttcttatggcactaacagttttctcgttaatgttcacactcacatcaacatgtagatgataaacattgtcaatcaaaacaccacttgtaattaatttattttttaaataaatcaaatgatggtctttattgaaattaaatatgtaatcttcctgtgttagcatagagacaaaagtcagatttctgctagatataggtacataataacaatcttttaaaattaatctaaatcttgatagtaatgaaaaaaggtaggtccctacggtgactacagcaactctggctccattttcgattcgaaggatcatttctccttttctcaaccttctactttctattaaatcctatatagaagtacatacgtgtgcactcgagccagagtctaatacctaactagaagtagaagaaaccattaggttagattcaataacgagcatattagatatacctttcaaaggtgtgtcatcctttttagacttcaggttttttaggatagagtcccttgaactctttaaggttcactcagtcgtgaccaacatattgatcaatttagataaagagtagtcgattttgttcatgtggtagtttacgataaattgactgtatgaactagtcaagaattacaggatcaaatccgtttgtaatttcttctacatcgtgatgcccagcttctcaagctctttcaagtccttaatcattatccaacaatattgtgaaccaactgcccttcgcacatcttagaattgaagagtcttttggacacttcaaaatgcatagtgcagctctactcatcatacaacctttgtaggtgagttatcatagtcctgacagtaagtatatactcatgctggttctgtaactcgtttgatatggaagccagtatgtagcatttcatcctattgtcatcatctgtctatttatccaatgcagtcctttggtcagcattggatggcttggcataattgggtggtcgtggtcaagtacataccctaattttttagagattaagatcatcttaagatttttgagtcaatccttatagttaagtttggtcaattggttggactctagaattcagactaaagggtttagagctaacatagttaaactacgagcatagaaattcaagttagatatttgtaattgaattttatttgatctaaggactttaagagtcaaataggctcctactattttttcggatctctcatactctctggatagagaaataaaaatcctaatatgactttgaattttagtaggtactgcaatcctatctattcacgcacacctcaccgtgttcgattattggtgacacgcaaaatcgatgagtggataactcttgtctaatacttctcaagtatattgcagtgactcggtctctaattcatgaagccttatcgtgcttggttattggtctaatccttagttaagtcagatccatcattcaatgaataggcaaagtcatcattgggtctctaaccgtgtctggttattgggcccaaccccatctctacgtagcaacatcttatgttaatagggtggttatgtctttccaatgtaactgaatcactgtaaccagttaagaacaattaacaccggttggacgcctgcactcctacaatgatagaagacctatgatttaatatttgtagggaggtttaatttaggtctcatcttaattagtcataactattatgattaaccctattgatgtgggctagctcaaatcaccaagtaaccacatcaagactaaccaatcaaattggccaagtaagtgcaagatcggtaggggtccctctgttatttttcttagatatcaataaattggctagatcagtgatggaaccaactaaataatcatctttttttagatcgaatcataacacttttcttagacaccaatagatcaattaatttcgaataggttagtttgtgcaatttgggctcgagctattaagtcaaatcaaatctttgagttaatcgattcaacatgtgactattaatcgatatgaccaatctacaactactggattgatcttaagcactcttgacctaatcctaattaactcttgatgagattgggttaaccgctcatctcgattgaactccatcatatattaattgattatccaaaaataattgaattactagacctaattaaacttgccctcacccaatttcatgttttatgcattaaatttcagatcttaaaattttatttttagatctattaatcttaatttagattttaaaatcttattttaaaatcttaattaagtgcattatgaacatgaaattcagtttagatatcgaaacaattttagatctcaacataaaacatgtatttcatacatctagggcttttttttcgtggttcttcttcttgattcgtacaggcactcttttttgttagaaatgtaggatagttgcaagcataaatttcaaaataaatttttgaagacagcaaaataaaattagattaatcctttaatctctcatgcagcagatcaaatctattaactatctaagcccaatatcaatgacatgcatataatctaaaaattaaaatatagattagagattagatctctataccttgtgtgggtcgtaattcactacagtcgatgatccatggatttgatgaggttcctcgagccgtacaaacatctgacctccacaggtatccacacgaggttcgttgtttgatcagagatccatcgaagtctctagggtgttagctcccttgtagactttttctcttgatgcctgatctgaagtcttctttggatctctcagacactctaaaagacaaagaagaagtggaggagatgagaaggaagggaaaaaccaaagaacaattctctcttttctctcaaaacccaaactagaagccctaatatctcccatgccaagatggctacaagatcacatgccccactcccttttcttctctcttttagtcgaccaaggatggaatgaacatttgatttcacacctaataagaagggccttttaatgatggcgacaaagatgagaggatgagaacaaattcccatctgataaatatcaagttcaaacttgaattcaaaaccattttaaattcaaataagaactaacttgatcctcatccaaaggagataagggagtggtcgaccagcctttgaaaggcatgcaaatcctatgccaaattcagattggtgtgaggatggcgtggggattgggtggttggtgcaaaagttgaatctaatctgatttggactcatgtttcttccaatttggttcaaaccaaatcacatttggttagatccaaacagattagagaacctaatcaaattaagaattagattccatgaatcaaatcctaatctaattaggattctattgcaattgagtcatctcatagctcaatcaggccaaacctaattcaagtcaaaataaatgtaattcaattaaactcaatccaatccttattactcaatcaaatagagttaattaacaattcaattactaattaatcctcttaagaatttactaactattaataaattatttattataatttttgtatatgattaatcatcaatcaaattgacgattttatcctttaatgatttataatcattgatcaatcatttgatcagacaagaacctcttttgtgtgtgatctcgaaggttctattctgtttggtagtgagatatatgatgatttttatcactatatcattgaaactcttttcgatggattgaaataattccaactctgtctatcgaggatcatcgattatcaaaataatgctcgacgagtcttataatccttcaatgatatctaacagtatgtagtgacaatctagtagaataaaagtattgaacctctaggtgtggttaacatatgattcagtcgttctatcgtgagtcctgacttgacggagatcatggagaactcatcaaatctaatgtcaggcatatgcttgatcggctcgattcaaattcacttatgaatctcatgaaaattttttttcaatatctacacttgcttcgatcaaagattttctgaactcaatcttgctaatcgtataggactactcattttctatcaagatcgattccatctagatgcatcctactcttaacagtgaacctgaatttactgaagccaacatatactgcaaagatctgaatggctagggatcaagtttaggtgcagtcaaatccagtaacctcactacaaatagccaatgtatcataagtcaaaagattatacacaccactgcagtatcgagaagatcactgatgagtgaatagatatccaaatagtttctcatattgatcacgttcagtataagttattctctaataatcatctgtactctcatcctagtatccctacatcaaagattcgagacttatctatttggaagagaggtgatccatataccgatcttaaatggattgatcactgtcctccgtgacgatactttgatcaggagtatttagaaattaaccactaataatgtatgtcttaaatctcaacaccttgagaatatataaaatcatctttattaatttttaggataaatcataggtacataaaaatgattgaaaataaaaatattttttattaataataaatattttataagtataaaattagatcatgaaaatataaaatatgtcagtcaataattagtttctaaggcacacatctaatatttttataatatgtctcatccatcagagacagtatctgaatcagtcacaaagactagaagatagactttattcatgatggttgtgtagagctcaattttatcaaaccatctaatatatttctattactttatcaaagatatatctttaatcagagtctagatcaattaaaatatataaaataaatcttgatgcgtgttagtgtgagccacatctagatggatttaaggagataaatcacaacattatcaatttttaacataacattatttttcactgcctatgcataatcattaaatgcatactcaattttggctttatttatatttcttattaataaaagaaagaagaaaaaaaaatttagagcttgcttggtgtcatttttattatatttttttaattttggaagtttaattcaaagcaaaatgatttgatgggacagctttttcaaactaattggtagaatccccgaatgccttaaatgtgatggtttaagattttagacataaaataaaaatggaaaataatagacagctaaagttgggtacaaatgctatcctccacatcaatatacatgtaaaatttcataaatttgtacaaaataaaaataccaaaaaaaaaagaaataatgccaaacatgctttcaatggactcaaatgtatgtgtttgtaaaactcatttatatcttttgtaagtgatatcgcagaaaatgggtccgatgacatggtgcaattgaatttgttcaactcaaaactaatgtggcatttataaccaaatcgggtccatctcgatcgatttaacagctaggatgactagactaggggtgactagtcttcgaggtcatgcatcgccaacgtgccgagtaaagtctcacagtttggttagataatcattcaactcaacaatcattttgaggcgagctggaccctttttcttgaacaatgactttagcacctctatcatggcaagagttaaagatcataataactaacccagataattacaatatgtgtcagtcaattatactaccatcctagatggttataatatattttaaggtgattacgttgtaatccaataaagttatagtatatctcttagaagattttagattctgttactgtcgatctccccgcctgaggtcggatgccgaggtggatgtggccgaggtgaatccaccattggagcttcgttcgagcacttgcaaaataagtccataccgagaggggtgactccggtataaacccttcgatgtacaaatcaggagatggagaacgatgagaagagagagttaggagtcgattgattgcttacctttgaagggtcctggagtttttatttataagagaagagttggagatgtatccatctcagagtcctgacaaattctggatttgttacagagatagatttggagaaggactttcattttatgagagattggatcacaaaagaagttctttcttatctagactttctcaatttgaaaggtcaattctgcatagctcgactatagccgatcaagttagtcgtaacggatgacctgtaggtcatctgggatgatctattggtcgtcaagagtaagatcctgtcttgtgaagctgatatccatcttcgatagctcagctatgactagatcgacgatgatgaggttgttggggccgacaccaaggtataaacctacagcagatgcccccactctcgaggtcgagcttttaatagatcggcctaagagagtacttgatccaaggttgaagcataagatgatcgaactgttcatggaggacacatgtcaggaattgaacacctgaggtgaaccatctttgaatctaaagcatccattcttcgaatctgtgggagccattctttgaccaatcatcgggtgacatttgtcgaacatcggatggaggtaaatcgttagtagatcggtgccattctggagtcctataaataggaccatggtaactctcttttttactacttctactattcggagggaaaactctggcacttagcgattctgcaggcttgctcagcaaagtcaagctagttggtcttcctcattcctcatttgctcggccacttcacttttaggtcagtccctctctctttgatcatgagtgagtttagcttttttgccgacacctaaaatttggatgatggccctaggagtccaggtctcgagatattaagctcgagagatgatgctgagagtggtgctcttatgacgtggagctcgagggataatgttagggatgtagatcctgagctcaatgctgcttgctccttgggtagatccgaggtttcagactttggtccatataggactgactctgtccttacctctgaggacttagaaatctttatattgaaataccagattcctgtcgagtttaggttagaggtggccctctcgagtgaaagaatagctcttcctcctccgagccaagttggcatgtacgaggaagccttaaaggtcggagttcggctgcttttccactccttatagtggaagttcctaaattatataaaacaagtttctatagtattacaccgaactcatggtgccaaatcataggcttttttgcccattgcatcttccttggggtcaagccgatcacctatctttttcaagtctgcttcatttttaaggagcatcccacaaagaacgggtggtggtatatttcttctcgatggagacgtcgtctctttcgagctcctacctcagtacataattggaaagagcatttttttatctagatcgaacatcttcgggacttcaatacatcataggatagaccacataggtcaaaagttagagctctagtcttaactgaagccgaggagaagacattaaagcagatcttcagtcagaccccctctcccttagctgaattccttattgaggatactttgtttagggctggattaagtctagccgatctaaaagtgagttgctatttggtatactttatttattttgataatatttttattttaactaacctcatacgccatgtagaagtggatcccagagatttcaaagctcttaatcgggccatgaagaggaagaagataagtacagcctcagctccaaagcacggtcgtcccaaggtcattcttgtccaacctactactaccagagattcctcgaggccaagcagaacctcgaggagggagttggcagccttcgtgagggaggtcatgcctctccaatttgctaccccagggaaacctgccccccaggcctctgcatccttgtcgtagagaagttcaggcaggccaaaaattttcataaaaatgtcttcacgtccgaccaacgtacaggctagatcttttgctctagtcggagcctcctcgggtgctggagtttaggatactaggtcggtgatcaacaacttccaagtccggtctatgattcaatcaatccttcttctgatcgacgtcgaatccttcaatgctgaaggaggtgtctttcgtatgcatgatgcatacgactctctaatttgggtaagcgacgatcttcttcaagttactcaatgatgatagatttcaatatttaatactaattttttttagctcacccatcacatggactactacaccaaggcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgggatgatctattgatcgtcaagagtaagatcatgtcttttgaagctgatatctatcttcgatagctcggctatgactagatcggcaatggcaagattgttggggccggggctgaggccgaggtatagatctacaacaaatcccattgctatatattggtctcgaatttctctatcaaacatacgatactaataacaccactacattgagattttcatttgtccctcccaccataattaaaacccgttgctaacttaaagcattggaaggcctaactagaggcaacttcaatgagttctctagcttgttactgttttatagattaatggagataatccgcatcagtggttcgaagattagtagcaagagatcaacaccttctataggaatgaaatgaaagaagctatgaagcatagaagaaacaactacaagtgtctatcgatcatatccaactggcgtttgatggctccctatgcagttttcagagatctcaacctcctcaatcaacttttgagctatcatcattgaataatttaacctactcatctagtaggtgtaggctcttatagtggcagtgtagaatttgtagcagcaggctgttaacctctccgctagccatccgaaccattaggattgcccagcataggatatggtcacccttctctccaacaataccaaaggagcgatcatcttagctcttcctccaagatagactctatccctattgatccttctccataccattgcaagagggcctctaggagggaggtcgatcttgattgcaagatcgaataaatgaacaacaagatcacagcatggagggaaaagcatgctgaagtaggtgatgacttggagatgatgatcaagccttcctttagcaaagagattatggaggatccactgtcaaagaaattcaagatgcctcatatcgaacattaaaatggtacttcaaatcccatggactatcttaagagttttagggctctcatgttgctataagaagcaactgtcgtgatgtgccaagcttttctagctacggttagaaaagcctctcgattttgtagtactcgagccttcaacctggcttaatcagatcttcaatgagttagctactagctcattggccactttatcagcaatagaagatgcaaaaggatcttggttagcctgttctcttttaggaaaaagaaagatgagtcccttctagactttattaatcgatttattgctgagatgttagagatccataagttagatcaatctattatagtaacaacaatgatgaatgggctaaaaggctcatactttagtttttcattgaagaaaaggtctctcaaagacttggccgaactcttatttcgagcatataagtacatccatgctaaaaaaattgtagttgcttagagggaggcatcaggaggaaattaaagaatgagctgagaagaaaagagcaccatgcgaccaacaagtctatctcgaagctttaagaggcatattactcttaacactctgagagctccaattttgatggagattcaagattagatctacctatgctagcctcgaaggttgaatgctcttgtcgagaagatgggcatgagcagatgtaactagattcatgaagatcttgagcatgacaccaaagagtgctagtaattgaaaaatgagatcaaagctctcattggacaaggttaccttagtcactatgttgataactagtgaaacattgatcaagaaagatgaatactagagaggcaaagtgatgatcaactgattgccagagtaatgatgacctagctcattaacctaacaagcttataatcaagcaatccgagcaagggagtcaacttcataaagatcaaagccaccaagcaaagcaaatgtagaagctccacatcgagcttggagaatatatgtcgagtagctaagttcgagaagcttgaaggagtacctataccccaaacataaagccctaactatcctatggggcataatcaataagaatcataatatcagatttttgtatgctttatttttgattatcaatgaaattgtatttcaatttttttttgcctgaagctagcctaaagaatctaaggtgcagtagatcctacaacccttgtaagagctactgaccttgttggcagagacacgccaagaatgactaggacctctgttcaaaagttatactataacctaggctcgaatggaaggagagatcttggcctaatcacctaggtgccagctattcagaagaacccaaccgtttagacccctattggctactcaggactatggtccaaccactaagcttggagaggaaaaaggcccgtaggccaccaaaaaaagaccatggctataaagatgaccattggccattaggacctaagtccaacccttgagcttaggaggcaaagtcccgctgaccataaaaaaatggcctataggcataccaacaatgggtatttcgctactacaatgcacgagtcaggtcaaagatttttcgatcgagagatctcatctttcctcaggccgaggtgtccaagccaatgaagtaaggcaaacttgccccaaattaggaggggccctacaaaattatcgaagtcatcaagcttggaacctataaaattgagggcgttgatgagactcccatccttcaaatatagaatgccaatagggttggtaattggatcgggccggattggatacagattagattgatgcgagtcggggcacaaaattatcaatccaaattcaacttgtttattaaataggtcaaaaaattagatcttaacccaatttatttattaaatagataatcttacctgacccgcttgacccatttattaactagatcaagtcaggttaaatagattaaacagattaaatgagtttttaatgagttaaatggattaaacaagtcgaaataggttaagcagatttttaaataagtcttaaatagattaataggttatatatctaaaactaaattcaattcaaatattaaatggtttataccccggccaccaacaaaaatggctcaagaccccacaaaatatgcccatggcaactaagataagcctttgtccttcgaaaaataattgaatacggatatctgaacttgggaccccaacgactaagtcggaaaatcttgaccacctggagttatctcaactacagctaagacctttgaaatagcaaacaaataagcaccgatcacagagatatcctaacctaaattaggacctctgatgataaaggggctaaccctccagggaccttccatggctaattggtgctcctcattcatggacggatcgaatggaggttagagattatgacgaaagagctaattctctagggacccctcatttgccaattgatgctcctcatccatggatgggtcgagtagagactaaagatgaccatgaaggggctaatcttttggagacatcccatggccaattggcgcttctccttcatgcatggatgggtcgagcgaaggttgaggatgacgatgaaggggctaaccttttaaagactcctcatggccaactaacgctcctcatctatagatggattgagcagaggtcaaggatgatgatgaagaaattaatcctccgaggacctctcctgaccaattagcactcctccacagatggatggagtggaggctaaggatgatgatgaaaaggctaacggtcaggaacctctcatggctaattagtgcttctcatctatggacagatcgagtggaggctaagcacaatgataaagtggctaattctccggagacccctgatagtcaattggcacttctcatccatggataggttgagcggaggctgaggatgacgatgatagggctaacccttcgaggaccctttctctatggccgatgcctcttgagcaagtcgaggatgaatccccatcaataccctctggagtacgtaagtgattggataaaggatggcgtcactgacttggtgaagatgaaacccatcaccgaagattaattgaggttcattcccaaatactatgaccccagacttcggactcggactcaaactaggaattttcactccatcaatagctcgattagtccttaggattgatgacctcataagaacaaacaaatggttggtctcgaagatcgagatcgttcaatacaaggaatgttaaggaaaggttcattatcactgattcatttaaagaaagttcattacaataaagtttgttacaaaaagaaagtgtaaaattcaagctcggtcgacatccttgggcatggcgatgaagtcaaatcttgattagtagagtgcccgacgatgcttattcggagaaaatttttttgatagttgctagtccgagccaagggatattggggatggcatgcttggcccccaggacccatccatctcccaaatattcctcttaaggaggatcgaaaagctaacttgggggcaaaaggttatcctttagaaaggtccaagacctccctagggagctcagtgctgagaaggttccctaagcgattgctcactcctcgtctggatcataaaccgaggtgacctgacctggaatgctgcttcacgtccaatggagccgagtaatggaaggttgacctcccacagtagatccccctggaagtggtcagtcctcggtgacacctttagaatgatgttggccatgattctgcgatggtcggagcaatgatatttttcaatatctcccatatcaaggcacaatatttgcaggtgcgccctctttcggtgccttatggctaaccagaaggtaggaaaaaatcccttccttgtatggtgaacacaagcagttatcgaatccccgacaaaaaaatagggcaacaacatcacagcctcttcctctcatttatataagacctgggtggaagcatattgcttcaccacccaggtcatcatttgccatgtgtcacggtccagtagccctaaaaaagtcatgcctcttagggaaagatatccttggcacctctttcgacaaaatatcgttttaagggtttagggtattaaaaatcacatgcgccaaagccaccaaaccatgcggccctccgtcgctttaagcacgccatgtgggctgatccacagaatacgtgcaagaccaccggcgctcgatatatagcagctagaagcaatcttcgaaccttctttttgaaaccatagccctttgaattaatcactctttataaatatgatgagatttgtgaagcaacacattaatgatgtctcgagattttttttgataagtgctaccgattgctggtcaaagaaccagttcggtaatcgactatcctctcatccaaggctgtaaaatcacttcgaatttgaaggtagaggacgaatattgtgaaagttatctgccatccgactgacatcttcttctagggttacgatggagtactcaccgatgagaaaactttggagatccatgggaaaaaccctgatgagtatatggactgcgcttataggttccgctttggtgctttgagtcttggacagtgtccggttccagtgtcatttgctttcttctgaagttttgcagcaacaggtagttaccacggtagggagtggggttagaaagaccaatctgaatgctgcaacggtcacaggaaaacggcggcggtcaagctcgctcactgaccaagcaagtacaatgtattacgctaccgttcctccacgaccacaagaatgaatgcactcgctgggcctcttctttggtgcgcgattgggtgattcgggcgctggtgcatgaatgaatgatttaaacgtctggtccacgtagcatagggagtgaggcacgctggccgagtggggttgctgtaagcgggcgagaaccgttggaggagggggaagccaaagctggacccacggcctggtttttggtctggttctggttttaacttttaaatgaatctggtccggggtcctggctgtcgacctcttcaaaccatccgtcccatcaaccaccgccaaaaaacactctagcacaaacaagctagaccgttcataaatagaaacgattgacccatactacccaatcctggctgccccgtttcaggaggctctcttcgccttcctcctaccttctgagagagagagagagagacgaagagatcggttgatgtaggtatagcaatctcatcatcatctctccggtctctgctctttttaattgtgccatctccgtgaggagggagggatggcgtcgacgaacgtgaaccatgcgtgcccggcgccgatgaaggcgacctcgaacggatcgtggcaaggggagaacccgttggaagcgtctctgccgctggccatcgtgcagatctgcctcgtcatcgccgttacccgatccctcgcattccttctccgccccctccgccagccccgtgttattgccgagatcattgtaagcatccatcttattcctcttcctcttcttcttcttgttcttcacaagtacgtgcgtagaggatcgccaactaacgttaacgttaagaagaaaactagcttctccgtcgttaacgggggacggagtgttggaaattaagctctcatggcccattaaaaaggctgttcgattacctgagctcaccttctaccacccattttctcgctatcctttccccctctcgtcgaggtttgctccgaactgagacacgcttgtggagtcaaagcttcagcatttgttttacaacaccccccaccaccacccccccaaaaaaaaaaaaaacttccatcatttctcgccgtccacattttgcacatgagaaaagcacccacctagccgatataaagatcgtacaccctgaccgatcgatcacctcttcgaacgcccccaggggcatcgaagcagaatggaatctccatgtcagattcttagtgacgcggggagagggattgaccgagagagaacgagtgcacttcgtattcaaggggaatactgatgttcataaaaatttaatagaataaattattattattattaagatatggacaccaacaaacaaatattgcatgcagggagggatcctgttgggcccatcggcgctgggccgcagcgaaacgttcctggagacgttcttccccaagaatagccttaccgtgctggacactctcgccaacatcggcctcctctacttcctcttcctggtaggcctcgagctcgatctccgtgcaatccgccgcaccggcaagcgcgctctcatcatcgccatcgccggcatctccctccccttcatcatgggcatcggcacctccttcgccctccgcaccaccatcaacaaaggcgttgctgagggccctttcctcgtcttcatgggcgtcgccctctccatcaccgccttccctgttctcgcccgcatccttgcagagctcaagctcctcaccaccgacatcggccgcatggccatgtccgctgccgccgtcaacgacgtcgccgcctggatcctcctcgccctcgccatcgccctctccggtgccggatccatgctcgtctccctctgggtcctcctctctggcgccgccttcgtggtggccgccgccctcttcctccgccccgcgctagcctggatggcccgccgctcccccgagggggagcccgtcaaggagctgtacatctgcgccaccctcgtctccgtgctggcctgcgggttcatcaccgacaccatcggcatccacgccctctttggggccttcgtggtagggatcatcgtccccaaggaggggcccttcgccggggtgctcatcgaaaaggtggaggacctcatctcggggctcttcctccctctctacttcgtatccagtggcctcaagactaacgtggccaccattaaggggggccagtcctggggcctcctcgtcctcgtcatcaccactgcttgcctcggcaagatcggtggcaccgtcatcacctccctcctcgtcaacgtccccgtccgcgaggccctcaccctcggcttcctcatgaacaccaagggcctcgtcgagcttatcgtcctcaacatcggcaaggaccgcaaggtattaattaatttgtgatctatttaatttaatttaattagctagctacctcgctcgatcggatgtacctgtagtattagttaatcgattataattaattgattgatatattcaaatatgggatgggaattatattatattatattaggtgctcaacgatgagacgttcgccatcctggtgctgatggctctgttcaccaccttcatcaccaccccgttggtgatgaccatcttcaagccggcgcggcgggctgcgacgccgtacaagcaccgtaccatccagcgcaacgaccccgacagcgagttccgcgtgctggcctgcttccacggcagccgcaacatccccaccatgatcaacctggtggagtcgtcccgcggcacccggaagcgccgtctcaccgtctacgccatgcacctcatggagctctccgagcgctcctccgccatctccatggtccacaaggcccgcctcaacggtctccccttctggaacaggaagcacaacggggaccagctcgaggtcgccttccaggccttccagcagctcagcaacgtcaccatccgccctatgaccgccatctccgacctctacagcatgcacgaggacatcgtcaccagcgccgagcagaagcgcgccgctctcgccgtcctccccttccacaagatccggcagttcgacggctccatggactcggtgggccacgggtaccagctcgtcaaccagcgcgtcctccgctacgccccctgctccgtcggcatcctcgtcgaccgcggcctgggcggctccgcgcaggtctgcgccagtgaggtatcctacacggtggcggtgctctacttcggcggtcgcgacgaccgcgaggccctcgcctacggcgcccgcatggcggagcacccgggtatcgagcttaccgtcatgcagttcgtcccccagccaggccagcacttcgtgaacccgagcagcgaagggagcatgggccgggcgacggatgcaagcgagcggctggccgacgagacgtgcatcactgagttccaggccaaggtgatgggggccaaccagtcggtcaagtacttggagaaggtggtcggaggagggaaggcggagatagtggcggccatcagggcgatggggaagttcaacctcttcctagtcgggcacgcgcctcgcgtaatgccgctgaccgacaagaccgactgcccggagctggggcccgtggggagctacctggcacagcccgagttctcggcgtcggtcttggtgatcagccagtacgatccgacggccgacgcgtccagcctggcggaggtgacggcggacatacaggacctgccggagcccgacacgccggcggcccagatggaccgttcccgccattaatattccagaggcacggaggggagtgtttttgactttgcgcacgtgctagcttacttggtggatacaatcagtaaaatgctgtggtttttagttggtgattttatgtccccccaccttccccttcccgtgattaaaccacggtccatgcatcttgcggataatatataagaactgctcgcacgtacatgttgctccatgcgatgatatttttgtatctatttattgggttccagctagcagataaatcacgacgttggtgcgtcgagtgatccatctctgtacgtgttttacacaaaagtggaattagtgccccttatccgtcccaacaaatataattaaatttcatgcattggggttgcttgttaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagatatatgaaatttgcactccttgtttggtttttttgaagcagttggatccttctcttcatttgagaatgtcccccttcctcgtgatccccaagagaaactaagaccaattcacacatagtttcatattctagtttgatagtttccatttgtaatcaaataaaaatttttattcgtcaaatatatgcaaatcaaatcataattttataaaaaaattattctgaaaatgttttggcgctctgctagaattagtgccgcataggattttttatttgtttaattgtttttttctagtaagccatgagactcataatcttcttcggtacaaattagggatggagagatccaattttctaattaattaggattatccatgtttgacataatgaccatgattagatagggtatatgatgtagcagcgtggatggttcctatatatccgattacaaccattcatgagcccctgattagaagattgggtctccttggttcatatgcggactcactccagttacgagctaggcgctcgtatggctcttcaattgtcattgcctacttccacagtgttatattacgctcacctcaaatcttccacgtagccactcataaggttccgccattgatgccactttccacacttaatgtcgcatagctgcagtccgaaagccaaaaaaagtcgaggggaaggaagaagcagagaaattgcgacaggagggcattttccaatttagggacacgtgataatgccttgtggagtttagtctcaagtgggaaatatttgttttctaaagaaagtccacggtgctggggcatctttgttaatgcttggactcaaaacgacggtggatgttagtcatcgagttcctgtagtttaattagacacataaactggcttggagaaaggaggcattttgacctgctttcagagccaccaaagcggtagctgtcaccagtataaggtcgctctcttctggagtaggggttgtatctctcttctgatgctggacatttcctagctcctagttagccgcgtcccttagccaagtcttggggaaatgggcaccacaaatttattctctcaatctagtattcattttaaacgtgcggttcggcatagcgacctcgaattaattaagtcaatgaaatgtacccctcttctatggtgagccattcatttgaagagcatttttaatctctctccaatcattcagcaccttccaagctgccacattcctcgtgttgttgtagctgacgacctaagtagaaagatcttgatactagaattcgcgcaattcgggctggccgcacgcgtggaaagcgaagagccacttttgacctctagaagtcgacatgtcttgatgagccaagatggattctttcatcattccctcagaattcaacgaatcatgagatttcatctcatcttcctatttatgcaacaatttcggagggaattaatgtatatggtgtgtgttggtgaggactgacaatccttctctttcgacttgagtcacacaagatgatctctttctggcccatgcgatgtaattaattgtttttccatgtcttcaaatccatcagcaaacctactccactcactgacttttgcttacaaagttagcgccaagaagtccatagttaatccactcttgtctagatcacgactgttcccggggtgcattcatgaacctgctagaagagagagatttacaacgcaaaccttcagctggttggtggccgtgcaaggggtatgtggcagggcaaactggccacacaaaaagatgctacacttaggcccctggtggaattgcgctgcagctgtacatagctttctaaagggcttgcattctcgatttttctactctccaagaccacgatctttgattcgatgagatggatgggtggagaacaaaatgtttccaccgaattccactccaagtccagaggatcgccactacctcaactggaagatgcccatcgtgacttttctgatcgatgcggaagtttcttctattcttgaagtttcttcaacggtgtcagatccttgggtggcccctgtctcaagtcactctatgcagcccatgtgtctcggtccaatcctgccaaaaatttttggatacaacacaaacacggttggccacttccggtgccaccctcagccgcagcgaattgagttcacgctcacgcggacttgaaaaactcattcccaccaaacatggacacggaggactttgagactcgttaacttatgatccacaaattgagagtcttgctgcggtgcagatcaaccagatcgcacctgggctgtcgtgaaccccttatcacatggttttgaagacctccagggccagttgctgtcaaacagatggcttccaacaccaccatcaacattgccttgtggctggggctcaactgcgcagacggatatgccaggactcgatttcattctcattaaaatttgtcttccaggataatccttaatatgaagtaaaaatgtggcgaacatttttgtgggcccgcaattttatggtgggacggctgattgagacctggtttgcttcctatctgatcacaagatcagggaaaaagccatgcgcgaaaaagtgtaaccgtgtgaggttcctttgctgtggcctgcggaatagttcatgcgggtccggtgcatgaccaatcaattatgtagtgttcctaatttgttggtagtagagcccgtgcggatttatcacagctcaagaaatccttgtaaatggcgcctaaaagtgaaattcccatgggatggatatacgagttcgaatcaactccagattgaacttgagagatctggcattttttcccccctccgttacccggcacccatgtatcattgtagaagggccgcgtatcgaatggaaagttggataactaataacatatatgtgctgtacccacttcgagttcatgatttttgatgcaatcaaaaagatgggcagagaaaatgatgcttccatggagcagagtttgacaaattctgatccactcccaagtcctctgctgtggactattcaagtgtgggccgttattctcccaggatcttccttatgtcaagtggaagatgctattgctacccactgttttggatgcaaaagtttctaatgttctttaattaggccagacagggtatccttatgtgggctagttgatctgattttaaaactttggatgtgtctcagcaaaaattctttgtgcaccgcgggcagtgcaaaaaatccgacgcagagtgcaccgctttatatgattgatctacgtagctaccactttttaatgtacatttaatgcctgtagttttactttttagtttaaaaattttgtatgatgaaaatatctcgagaatttagaaaaaattatgacatcctatagtatattatgaattcctatacgcagaatatcataatatgatctagaaaattaagatattctgtagcatattatgacatcctgagtcaaattatgactttttacatgcaggatattataatatggtctacgatgtcataatatagttcagaatgtcataatatagaaggagcatttttatccaattactttgcaatactaaggctggaagtggattcggaccgacctgaggtccgtcgagccgggccggcttcgggtcgggctttgggcttggcctaaaaccatttaggtcgggctcgggcccgggccaaaaaataggatctgttttgcttttgagccacgcttgggcagacctttggcctggcccgggcccgagcccgagctcgagcttcaacccgaatatccgatccgagctcaatctcctactcaaattggtttagtccgattaccctatctgaattagctcgattttaattaattaatactaatttgtttagtcgattaaattgaaaccttagccctcccaatccctgtgtctcgatctcccccgttgtttcctcacccaagaaaaaaggaaaccaaagccctaggcccctagctcttggtcgtctggtccatagccatcgtgatcaccaccacagccactgcctgatcccaaaataagaacaggagctatgatgaagttggtggcaatagggaaaggaatgatggtggggtagagcttgaggcgagcggagagctatcgatgttggggatgatgaggcttttggggggtggggggaggagtttggggtggagtggggtggcacagtcgagctcgatattcgtgacgtgaagtcggagcatggggcgaccgacgagggcggaggcccgagcgggggaggaaggggagccgttgtcccccaaggtcaataagaacaagaataagagggacacaaagatgtcgaagtccagggagaggctaccgacgatggcggagcggtgtctgtgcctctagaggtcgctgtttagctgcgtgttcatgttggtgggatatctggctaggacaccatctttcagaaccttttcgatatcgcacgatgcagcaggaagaaagaagaaataaaacaaaaataatcaaatacatggatcagccaaaaaaaggcatgcctccatggggcatgcaaacttcactatgagaaaaataaatattataagagaatatttcaccatcaactctcgtacatccaatttctccctcacagaaaattctctctcataaaagctctttctctagaaaaaccctctgaacccctgaaacgatcactgttcgctgtccaggagcctccctactccttctcttagcgtcctcacatctctctctcttcgcatgggttcactgtttttgctgaagaaaaccacgccgccacaaaactgtccacgccaccacaccgctctgttaacaaaaatagggcttttatagccttaaaacccaataacaataggattaggactcttaagagcacccaaagaattttttcggaccattggaaagaaaccggaagcaacccatgccctccaatcgcgcaccgatccctgaaatagtccgtgaaccatgagaaacgcataggaaacgcccatgcagtccatacgctctcctgtgcaccgctcgatccaccgtggaccgaccaatcctgggctctgaacctgtgcacgagcgcgcgtggacctgggccacacccgagcctgtgcgcctgggcttgggccgcgcccgggcctgcgcgcctgggcttgggccatgctcgtgtgcttgtgcgcctgggcctgggatgcgccccacatgctgggcctggctctgcgcacccaggccacacgctgccgtgcctgggccacacaccaccactcgcaatcgcgccgccgccgctccaccggcccgccagcggttctccaccgctttgagtttcatgctgacttcaatcgagcatatctcgaccatccgaactctgtttggggtgatcttagtcttgttggactccatttatcatcatggatctcattgtgggctcaatatggatcgaattttgaggcatcaaattctaacaatcttcacttcgactagatattcgatctctttctgactctgagagcttctgtatctcctcacccccatgtcttggggcaatcgcctgctgatcatggatggacaaacatgggagtcgagtcaggctactcgatcccattttcattgtatgctgtgctcctcctgatcagagacctaattggggtaccattttgcggcaatagaaatctcaccttgcggtatcgcctttcatcctctcgaatctcctatctcgtgcctgatccacctgaaggaaaaattgtcttttttctttgtaggatcttccagattttatcaaatctaggatggaataatttaaaatttttatcctacgctatttcagatctaatgtctgttagatctaattttattatctgatatttaaaatctaaaattaaatctaaaagtataagaagtatagacatacctcaaggataatctgattactctgtagatgatctcagcacagtccaaggttctgatgtagccatgcaaatgtctggcctctaccggtatccactcagatcgaacctggaacatcttttcttcgtgaatctacgcttcaaaaatcagatctctatctgatttggaagtgcttcagaactccttctgaagttggagcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagactcttcgtcaggtaataatatcctctcatcttcttcttcccctccagaacaatcctatcgccgcatagcaccttcaaaatttctccaccagctaccatttttgtagcttttcgaactagtctgctcagtgagataagattctgtctgaaattggatatgtatcggacctcctccaatctcctcactgcatcattatgtgtcctccaactgaccgtcctgacgcctctgatcacatagctcgatccatccggcaaacaaacagtaccctcactgttctctaaggagtcaaactgcttctctctacaacatacatgataggtacatgtagaatttaaaatctactactggaaagaagtagatacctcatcagatatctccaggacatctccctttgaatcgctactggccatcgctacagcagccatcgtttgatccctgagttgagagcaatctctggctagatgccccaactcgtcacaccggtaacacctgattttgcttaagttcctcctgaacttggaccaccctcgttataatctcttgttgctccatctacctcctccagatcctccaaaaacaccactgctgagctgccgatacttgagctcgaagttggtttctctctcttgagaacctcattctagagtatcgccacagtggcttcatctattttgatggtgctcttctccactagaagagcaatcaccaaagactcatacgaaggtagaagcgacgctagcaaaaccagcatcctagtcttctcctcaatattcttatcaatgttgaggagatcggtgaggatcttctagaagtgactgagatgctcctgcatgctttgtccctcagccattcatagctggtaaaactatcttcagagaaaaagagtgttggtgagagatttctccatatacaactcttcgagcttcgaccacagcaccgtcgaggaagtctcgccaagcacatagatcactacctcatccgctaggtacatgcgaatgatactcaccgtctgcatctagagccacctccaatcctgcacctctatggtggtcggcttctcctagcacaagagagcattgatcaacccttgctggatgagcacgttcttcacctttgcctgccacaaggagaaattactcttttcatcaaacttgttgatctctatcttgattgatcttgtcttctctatcttcaatcttgctcaccactgctacaatctgcgtctttgtatcgcctcgctctgataccacttgttagtgggatatctagccaggacaccacctcccaagaccttttcgataccgcacgatgcagcaagaagaaagaagaaataaaacaaaaacaatcaaatatgtggattagccaaaaaagctcgcctccacggggcatacaaacttcactatgagaaaaaaaaatattacaagaggagatttcaccatcaaccttcgtacatccattttctctctcacagaaagttcttcctcataaaagctctctctctagaaaaacctcctaaacctctgaagcgatcactgtccgctttccaggagcctccctgctccttcttctctcagcatctcatgtttctctctctttgagtgggttcactgtttctgctgaagaaaatcacgccgccacaaagccatccatgccaccataccgctctgttaacgaaaatagggcttttatagccttaaaacccaataacaataggattaggactctcaaaagaacccaaagaatttctctggatcgttggatcgaaatcggaagcaatccacgccctccgatcacgcatcgatctatgaaatagtccgtagaccacgagaaatgtatggaaaatgctcatgcaatccatacactctcctgtgcaccacccgatccactgtggatcgagcaatctcgggccctaaacccgcgcacgagcacgcatgggcctgggccgtgctcgggcccgcacgcctgggcttgggccgcgcccgcaagctcgtgcacctgggtctgggctatgccccgtgcgctaggcggggctctacgcgcctttgccgctctgccggcccaccgtcgatcgccggcggtcctccgccgcttcgagttccatgccgacttcaatcgagcatatctcgaccactcggactccgtttggggtgatcttggtctcgttggactccgtttttcattgcagactttgctgtgggctcaatatggattgaatctcgagatgtcaaatcctaatagttcaacggttggaaaaagagccctgatgggcagccatggcagtctctgtggtggtggtggcggcagcggtggtccagagggagggcagggaggcctccgacgaaggggacatgggggagaggttctacgcagcggcgatcgtcggagggagggacttgaggtggggcctggaggagcacccaccagttattgatggagccaggggcggcactagcgatgacgtcgatgagtttccagtagatatcatggagcccagcgaagctaagcaaaggaaggcagggcactcgagctagcccaatcaggctcgggctgattgttttccaaaataattgtgcctaacttcggttcgaagctcgaaattttttttttttgagctaggctagggtaggaatagagcccggcccagcctaatccagttccagccctatgtaacatgcatttaatgcttgcagtttcactttttcatttaaaaattttgaatgacaaaaatatttctattttttgaaaaaaattattacatcctatagtatattatgacatcctacgtcaaaattatgattttctgcatgcaggatgttataataaggccataagatgttataattttttttcaagaacagagatatttttatcatttaaaaattttaaataaaaaataaaattataaatattaaatatatattaaaaaataatgattacaaggatcaatgatataaagtgatatacttcatgttagatttttctgcattgcttgtggtgcatcaagaatttctactgtctcagcttggttgtgtcacgccggatctggaatccatcagctcggccgcatgacggcctgatggtatattgcttagattggcccagccctgctcacaacttcggatgaagtgaccctgcctccagccttggatccgcgcctgagagctgcaattttgagacgtgtgtacgattcctgatgcggatgaggtgtctgatggatacggtctccatcgtgcatcacacctaaactacaccgtagcgagataacgacctaccctagccttttcatgccatcacatgtgaagcccacgcattaggctcccgtgctcagaggagagcagatatggacgccgcaaacgtttgggacctctaatgccaatttcccgtccacaaagggctaccaacccagcagcgttggtccgtggtcgattggggtttaactgcatggatggaatataacgcctaggacaacccgggctagattttgtgctccttaattttgtccaccaggattatgctgccgttgtttgtagcggggcatgctgacgcatgggaacgcaaatgctgcctgaacattaaagggctgcttacatgtgcacaaggcaatacacatgggcatagcatactagcaaggcccatgaatttggtgtgaagggtgtaacaaagtgccacgtcatcatgtaactatccaaattggaggtgggtgttccgcgttaacggtactccaaagatgagttggatttggccggatctgcctttgcgttactgtgggttgaccaattgggaccgagtccaggcccaccaccaatgttgtacagcaaaagcgttggcatcagaccacttgagggcccatttttggatgacaactgacaagggggccaatttcgtttagggcccatcaaaactgaaaaaggtgccggatcattatcgctaattagtttgtaattttgtatgtaaaaacattagaacaattttcttttccaaccgaagcattaagaacagttttactctatcatataattattgggaaaaaaaacaatcattatgagaaaattgagtttgattaaaaaaaaatttctaaatgcttttttcctgttttgtgcctttaatccaagagtgtgatacatagttaataaaaacttgtaaaatgaagtgctttgcatatgtaagccagcttatcagatttctttcccaatctccaaattgtaagttaatatgaaaataaactaggtcatttgtcagtcgagttgtttcttatatgatgaaggaatatttaacaatcaaacccttacaccaaatatgactataactacatcttgataaagctccaggtcctgatgatttttctaattttttctttcaatatttttgacaaatcattaaaaaagaggttgtagaagctgttaaattttttttttcttatggctttatccctaactcattggaaagaacatatattgctttaatccctaaggtgtctagtccagttggagttactaattatagaccaattagcttatgtaacaccacctacaaaattattgccaaacttttggttaattggttgaaacctatattacctttgctgatctcaggggaacaaggggcatttgcgcaagaaaggaatattcatgaaaatattttgttagctcgaaaaataatgcattctcttcaaaaaaatctctccatctagaagcttgatgatgttaaaattgaatatggagaaggcttatgatcatcttcattggccgttcttatttcaaacttttcaacactatggatttcataataaatttcttgcttgggttaaagcttatgtcgacaaacctcagtttgctctttttattaatagaagcattacttcttgattttttccaactaagggttttcgacaaaggtgtccactatcaccttatctttcatcttttgttctgaatttttttttagatttttgcattgtgctgttaatgctactctgctgagagcttacaaacctagagggggaccgataatttcacatattttctttgctgatgattgtttgcttatttttctggtaaaacttcgagatgccattattattaattctattttacatatttatactttcatatttggacaagcagttaatttttctaagttgcatataattttcagcccatctatatctccaattatcaagcatcaactctgctccttgtttgatatcatgccacaaaatgatacatggaaatatttggggattcctatctctggacaagcttacaaagtttctaattttgcatttattatggacaaggtatcatccaggattgctagttggtctcgaaaagtgttatctcttgtatgaaggacaactctaatttcttcgtgaaggatcgaaactgcgcaccgaatcgtcaaagttggaggcagcagatttcaaaattttttcttccgacccggcatgcaaaatatagatctaaatcatttatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgggtagatgatctccgctatccaatgatcatggtaaaagattcttgaggagctgcgcacttgtccaacctctgcggatattcactctgacctggcctgggatgctttcttcggatttgatccgcctatgctatggtggatcaaatggctccttgatcagttacaaaactgatctctgaggggctgtcaaatcaatccttgacacagccttttcttccttcacttggacggcgcctgaactccttcaagcgtacttcaaggattggcccaactcctttgggcactaagaggggcagcagcctaacagcttaggcgttgagatcggagggaagtggaggtggaagagaagcagggtttcggatctaacacttggatgccgaaccctttggcaaggggtctaatttattgaccaaaaccctaaccacatgcaaccaattttggtggcaccttttgaaatcagatttcaaaaagggtgcgccctcacaactctcatttctgccctatccacaaggggcgatgccccttagtttctctttgaaaaaaagaagggcggaagcccatttgtcttaaccaaaaaggaagtgtgtacgcccatgatcttatcttggcgtgtgtcctcttatcccattcaaattcaaacttaaatacttaaatctcatttaaattcaaacttaaattcaaataggactaaccactctatttaaatttaaacttttcaaacttaaactgaatgaggcagttgccttcatccatgtccacctacgtgagactttctcatgcagtgatttatgagaggagagaaatggaagggggcaccaactcttggcatccttccacgtggatccacaagggcatgcatcccttgaccaagtcaagggaggcatgtgcccttcaaatttgaattagattcaaatttaaatgaaagaggcttagtgcaaccaactattggtatccaatttagaatccaaatagattaggcttagccctatctgatagggaacccaatcctagagaaatctagatctaatcatgtgctagcatgattcttttagacccaattaaacctatgtgagtctaattaagcaatcctagaccaaagctcttgattgtgtgacccaataggttcaattctgcatggtaatgggatatattgtgatctctatcagtaatattatcgaaattttttttgatggatcaaaactcttttcaattcagctaattaaaattattgattatcgaaataattctaattgttccataatccactagtgacacctagtagaatgtagtgacaatccatcagaactgaagagatgaatctctaggtgtagtatcgtgtaatttggttcttctatcgtgcattccgataggatcgaggttaaggataactcatcaaaccttatccctatcatatgttagaatcaatcggttcgagtccgatatgaaaccttatgaaaatatctttctatattcacactactgtggtcatgggctttaagactcaatctcatgatctacataggactactctttttctacctagatcgataaatcccatcttggtgtaatctaattcctacaataaacatactgcagccaacatacacctcaaaggtctatatagctaggagaccgagttatgatgtagtcaaactacagaaccctcaagatgagcagctaatgcaccttaagtcagaaaactacacactattgcagctttgagtatgttactgatgagaaggtaaatatcctagtgactactcgtgataggtcatgctcaatatctttgttcctaataaatacttgcatttttgttccgatgtctccacactgtagattcaagactcatctacttgaagaaagcgatcatgcaccaatcttttcggatcaatcattatccccatgatgatcctacgatcgaaaataatttatgagttaactaaaattaacatatgtctcaaattttcaactattaagaatatgtgttatcatatccattaactcaatggacgattcaaagacactataaacacaatataaatggataaaaattcaaattttattaatataaaaatcaattatacaaaatatatcttaaaaaaattttacgagtgtcgactaatctgacttctagaatatatatccaatacttcgatcttggcttctattcctttacattctatctcatgtgttcctgtccttattgctactcttttgaagcttgaaaagaagttttgtgctttcttgtgggggcacccttcagaccgcagaagccttcatattatctcatggagccgttttgcatgcccaaaaaacatggagggcttggtttacctaatctggttgagtgccgtcaggattgcttgtgcaagatggctgcttatctagttctacaaccgtcctcgttatgggctgaagtggtaaatgctaaatacaattttaaaggaaggtgggactcctatattgtgccttgaaactgttcaattacatggaggaaaattgcttcatgtggtaaactgattcaaaatcagtttcaatgattaattggaactggtcataaggtcagtgttcttaatgatccttgaatgactagcatacctctaatcaaatggccagcgtacctgaaccttatgatcatctatggaattctcggattcttgaaaactgtttctctgctgatatgatgactcagatccaaaggatccctcttagtcatggattctgggctgatcagctagtgtagagtcacactaaaacgattcatgtttctctgtctaatgttaatgcagtttctcataatcctgtgtctgtaggagctcccaattttcaatgggtttggaaattgaaagttcaaccaagggtccaaatgttctggtggagattagcttggagcaaattgtcttgtaaaaaagtgctgtctagaagagagatgattccaaataataagacctattgtgaaatatgtcacctggccgaggagaactgtgatcatgtgatcgttcagtgctcttttgctaaagaatgttggacccaaatgaaatactttagcaacaatgatttctaccctacctccctatcaatgctgattgattttttgtctaatgcaaagatgggagaggaagacaaagctttgtttgctttgatggcatggcatatctggatagctcgcaatgagcagttgtttcagcaagtagttcagtcccctcatcagctaataataaagaccattgttaataacataaggtttgggcatcataatatttccaaagcctctggcatcccgtcaaggtactgggatagtcatatgcagcatttgcaaccttctaattcatttaagatggtgttgtgactgcctccttcctctgggatgttgaaggttaattttgatgcatctattaaaaataaccaggcagcagcaggctttgtgattagagatgatgtggggagattggttcgagctggtggcaaatctttgctgccttcgtccgtccctatggctgaacttactgctgcctggttgggactcaaggtttcgatgcaagaatgtagtgctgaacaaatttggcttgaaggggattcctttacggttatcaactggatcaaaaattctaccagctctaaaatgcaacataaccctctcttgcaagatattttggcttggaagacctcacgattagtatgctatgtctctcatgcttatcgtgaagctaatcaagctgctgatttcatggcaaactgtgcgctcgagggggacataacgtggaaacatggggatttccttgattcaacatttgctgctttacttcaagctggtgcatacaatgtcatgcatattaggtggtcatagcaagggagatcatcttagctattgggtggctgaggtgacattaatttggagcatagtactctattggttaggtcaatgctgtttcatgtgcaggtttcaaggtgagcatagccatcaatctgtgtatcacaggtacgaatggcacagctgtaagttatggtgcccgagaaatgaaaggagatcaattgcaagctacattttcattgcatctatatatatttggtctgaatttaatattcccagtcgtctatcatgttcaagctatcatacagtatacactgaaggcattaattcaacttttactaatctggaatgcacactggattggtggtcaacatcaattttctttcattggaatgtccagctctggtaagtaattgattgttttatagttggctggagccatgaattaatgtggttatgccggattctttatgttgtttatgatcaactgcaaaagatagcaagtcatgtgatgagatggcattgttcacaaggcttatattctatcatctcaatacagttttatgaacagcagtcttttatcaaattggttcctggtattgaaattagtctggcccctacaggaactgttagaatattaacactactgaagacccaggcgcaaatgcaatatatgtggctttgttggatgcaggatattattattgtgatcatctgggagagtgagtatcaggctggagtactcaattactcaagcaacaaggttcacactctgagaaaggaaatgacaagcaatcaaaacatgcttctctgtttcagaaatcagttgcagagtttttaatcatggatataatgcactgttcaattgtttcttatatttgcttcctactgccattacatgtctgttagatgcaactatgcctcatgttcttccattacttatgcctcgaatattaacaacgatattctcctatctaccgtggatggtatgctttgtctattatatctccgcatcaaaccatgttacagaaggatgaagctggatcattataatatatatgttagtatgtggaaacagctgcagaaaggacacaaaatttatcatcttatgtgcaggtctacaggggcattgctttatttcaaggctaatcttcaaaataaactgttgcaaagacttctactgctacaaccatctactaatatggcaaagctttcaaattggttgttttgccataaggagtatctgatttcaattgatgacaagcttctatgtatatttcatagctctggcaaatgcatctatggagtctctttatgtatcgccataattttttttttttgtccagcagtgccactgcctgattgcttcatcccagtgctacaggacaatgagatctatcttccaacagctctatcatggggaattgtttgctgcacaccttacattaattttgttttaagtcacactgctgttctctttttaataggattgttttggttcagctgtgtaatatctattgtacctttcaaacacttgtacgctggttttaatatttaagtgatagctcctcttcttaccccgccccccccaaaacccaaaccaaaaaagaaactagattacgtgttatgcattgcaaacatcattagcatccaatcaaagagtttgtcctaactataacacaaccaaagttggatttttaattgggtcgaaccagatctttaatgatgatcaacgattaagccaaaccttcggctcagtccacgagacagtctacaagacaccaaatgccaattgtcaagtcacctgattttgatcaaggaattgcctaatataacacatagctttattccaaggtagcagtcttcagcctccaaaaccatcacattggactgaatcgggaaaaaaaaaattcccagccgatcccatttatttatgttggaggaagttgatgaaaaacaacatttatccaaaagaaaaggaaaatggaaatcctcagtttacctgttactggttttttaaatttttttatttttttatgcgaagggaagcagggccacgcataacttattaaaacgaaagtgctattcccacagtttatttatttatagaaaaaaaaagtaggaatagaagcatcagagatagaagcagaggtataaactcagagaaaatatcccatggtatggatgtagacgggcgtctgaatttggcattgcagcaggagcaaatagatttatagtaacagtatcatcctctagaaacacagcatgtggaatgttcaggtggcgtgaaaggggataaggacttcaatttgttccaaagagtggtgtgatcttctacggtcttaatagagcacaaatgcccttaggaatgaaagtgacatggtatataatcagtctacctatcacgattggacacatggcaagcaattttaaatatatttgaattttaaatggaaaaaatgagataaaaaaaaaaggagattatagtagatttaaatccaaataaaaatagaggttacagcaatcccttaatttctacctccaaatcgtaacggatccatgcttctgaacctatataaatagggccaaggggatcctaagaggatagattaagagaaagagactttcataactcaaaactctctagccctcattcattatcttattttctttttttcttgtaggtctataggtttataagcacctgagaccaagggtgatgcgaagatgatgcccgagttcaagatcgagatcgaggtgaagactaagcctaagactgaggtcacgaataaaccaacctcagaaagtcgacatcgtcaaaagaccaagaacatgagaattctgacttgaggaagttgagatcatcagaaggttaaggacatcagaaaatcgatctaaaaaggctgagatcatcagaagattgatgtcattagaaaactgaaatcaaaagatcgacgtcatcagaagatcaaggttatgagaaagtcgagatcatcagaaggtcgatctaagaaaattaggatcatcaaaaggctgatctgaaaagatcgagatcatcagaaggttgagatcatcagaaaactaagagcatgaagaggccgatctgagaagatcgaggtggaaagctgatttgaggaggcctaccggatgtagcagacctaaaaaaatcgaggtggaatgctgactttcaaagactgaccatccaaaatcaagctccagtctgccatcctcacccttatcttcctcttccacttctataccctgcaccactatagtgttgatgtcttcattctcacagacctgattggtgctcttatcgtcagatccctcgatgatttttgcttctttgttggcccctattttgttcacccaagccatcggattcatcgccttgcagccattgttgttgttgtttttctcttctccttgcggccttacttgtcacccccattgatttgtaaagaccgaggaacttgcctccatcctaattcgattcatggctccttgatgaccctgcagcactatgatgagttactatccaccactatgttgtccttgcaagttcgtctttctcatttgtcaattttcagattagaaaaatttaaagagagtttttttctatttatattggtgtgacgagttgatacatgtggcggatagagattgatcttatgtatcgtcaaatttaattaagatataatttttgaatattcacgaacttggttattattattattattattattattattattattattattattattattattattattattattgaagaaagcagcatcattggaatagacgggggtgctggacattgcccgaaacgatgagggcattttcgtgaggaaaatgccttggctttccgggcaagtaaagaaaggaaaattgcgagaagggggctgttttcccaaatacgatgaggcttttgtccgcctgttttcgctttcccattttatgtccgcgtctgcgtctgcgtctgcgcgcttgtgcgcgtgaactttgaatccttcgcttaccaacaaatcacaaccaaattgtaaaccctatccttttcttcttcaaaaaaacaataataataaaagaaaaaagaaacaggcatccatcagtcttcccttttgttccgccacgtctctctctctctctctccttctactcgccgccctcctctgaccaccaattccttgtttcctctccatctaacaagtgttcgttcgaagggcgtccgctgcctgctctcccacctgaagaagaatccttgcccgctccccaggtattgcaaagtctcctactagatatccccctgcttctctttctttttctttttcttattttcctctattcgttgattcgatgatcgagaactctgattgtagcggagacttaaactctgcaaaaggggctggctgtagtttctccttaatttgattttctttctttttctttttcttgttttcctctcttcgttgtttcgatgatcgggaactctgattatagcggagacttaaattctggaaaaaggggccgtagtttttctaattcgggtcctataaaataggaggaaaaagagaaacgagaatgaaattctagaaaaaaaattttaaggagagagaaaggaaagggaaatcttgctgaggtccgaagcaaatagtatatgtgcctcaacgagtttatgaagttgctttattttgaacgctctcttgatgatgagtccttgatcctcacttaaggagattgtggagcgtttagaggattgtagaaaccataattgaatgctcgaccgcttaaagcagggacggagcaagtgcagactcgggtaccataggaggatgcagttccttttttcataacactaggaagtgcatgtgttaatttccttgaattggtgcaatgttgtgggcttaaattatacgactttatgtattctagaatcttcagaagttggtaagaaaaagtgaaatctgtgctctggtagatattctaattagttaggtcttggtggcccacaaatgcatctcagcaagaaattgttaggaattttctgtatctccaatgcaccgtctttgtcttaatacatatgtgcattcgtgtgcgtaatttgactgaaagtgaattagttagatcaccagttattctttcccagcttgatgttgatcaatgggcactcttaaaagtttttcccgtggtactaaaaatgagataatgtatcatttgccccttttcttctcaacattgatctggcaagtatttgaaatgtttttatgccttgatgtggcttttggagtagttgacctagtagggttagcatattgacagttcctggaatattataggagtaatatgtcaaagtgaaacttctcttgcctagtttttaaatgcaatgccgtgttaaagttttacttgctgtcttgtagacaagcacatagggaaacatgcgagtccgtgggcctcttttgaagcaatgatttttcaagttgtaaagatgtggatcaagtatttgatactgaatattggcatgctaggtttaggtaggatacaaccaattacttctttctccttgcttgtgatccaggtatgattgtcaaccaaataacaaaatccaaaggaggttcctttggatgagggaagaatgtctatgttgagagttatcatgtagtgatttagataatgatgctaggactaagaggcaatgggcttagagatggtgttttaagaacttagaacttttatattatgaatgttgttagagacctgagatgctttgggaatacttacatgtggcttcttgggcatgcgattataacaaaatactaaagtatgtgaccttcatcattcaactctctatcatgcaacagcttttcctgattgtatataggaaaagttacctaaatcttaagaaagataaaataaataacaaagcttaattgaaaagcaacgaatttcaaaccaaaagcaacttaaagtttccataaaataacatattatcatgctaattagtaatggcatgcttaaactttgaggaattttcagcctctatgatgatcaaactaagagcagttaaggaccagaaagttgtggactttactttccagtgagtaataacacacatttaaataggtaaattatcaattgaatgcctccatatagacattaggttcatgatacacatgagttgcattttttgttggcattgtgcccccagcttcatcagcctaaagttaaaactatgaaggtgatatttttttaggttcatttggtaatttgccaagcttgaagctttatagtcttcatcatgtgaggtctctcattgatgtctgtatcctgaaacaccatttcagctaacaccctgatttacttatattcttgcattcttatgctttgttaccaaactaccttcctcctcctccattcttgtagaatcttggtctatgatttaccttcagttttatttttattctttttttctcttttcatttttttttgagggttgccagggtgaaggttggttcagtattcactatattttttttcttcttgattattgtaaagttagatttaaaactctttagctatacttatttagtgtgaagaagacagatataccatgatgctaatctccagtactacaatcttgagttaaatagctgacatgtgattgatttatgtcaagacaaaagcccctttttattaatcatgacattatatgagttttcccccctaatgatttgatgaagtgtgttgacaatcatacttaccagctataactgaatgaaaaatgaagacatgttcttggagaaagccagatggcttggtcaaggcaatgtttatcaaaatttaaaactgggatctttctttggaagataatagtaacatagggatgtaatttgctaaagtcaagccctttgtcagcatccaccattcagctcaaaatttgggttgataagggatcgcttgattagtaactgagctgagatagagataggcccggctcaattgagtttggcttgatgatgcttgaaatccaactaataatttattattattctaacaattatctatagaaaaagagtaacgtgatcaacataatgtagactacgtttctatctaacaaatagagtagaatgtatttcagttataatacgaagatatggtagtggaattagcttaaaagtatatgaaaacttaagaaccttaggctttaaccaaatctcttaaaagaacttaaatggctcgaatttgactcaaatttaaattggatggcttaggctttgctcattcgtagaatgagccaagctggagctgtttaagttaaattgtaattttagagagtccaaagacaagcaacagcatttaacgctagagtagatggaaatctaagaatcactttatgactagcttttgtagaaatgttttgagatagttaagaggtgaaactggtggagatgaagtctggagttgtgcattctatctttagatcgaggggaccagcacattagctggaatggctattatgaacctacatcaaaaactgccttgtacctcccttaaaggtgctgggattggattggcttaattgagcttaccttgtttatatgcctagtcagctgactccttttcttgggtgaggacatgcaaagtagaggaagtagaacctctgagggtagataacatgaaatacccttttcaggttttcaataatcatacatgtttagataaaaaattttcatatttattttcaacctttatggcctcggaatgtaatggcaactcatgtgcaacttatctatttacatttgaattgtactaggggatgaagagttatatggtatgatggtgcatatcaatgtccgccatattgacttgtattgaccgtaccatatagtaccgataggataccaatatggtactaaggtttggttcattatatgagctgaagtggtctgaactgagcggaaccacctcgtatcgcctaatactacttgaaattggggtgtgtaccatattgtactgatttgtatcatcctgtttcggttgatattgtgataaaaagggagaaaaaaaggggttggaagctatcttgctacagggcatgtaccgtcttgaccggaccatgctgaagcaatgatatctagtactaagattggggaccttggtgcatatattaaaatatcgaggctgtttaaacgaagtatatggtaactgtaaggatgattaccaatcggttgatacaaactgtatttttgatgattaagggatccaggtagtttaaacatgacatgaattctaaacatgagcactgctaatggattttgagaatgagcacacatttagatgtgcatagattaagtgaagctatggtaactgaccaatttaatcaaaagcttaacctgataaggaaggggtgaatagtgtatattaggcttaacaatgtcttatgtgtggcttggaccaagcacatggagggataactgagtcaaaactaattgaaatcagattaatagataaccaaggataattgaataaataactagacttgagggaatttgaactcatgaactctaatatatttgagctatgatactatgttaaataccaatttaatccaaaattttaacctgatagggaaagggtccataatgtataccagatttaaattatcaaactttgagtttttattaataaactaaactgcttattattttatcattgtatgtcctttgcagatcttgttgtagaagaatgaagcttttacatatcactgcatttatgttgcttgccccccaccccaaccaaaaaaaaaagaaaaattatgataatcttacaccagcatactgtctgttggtttcatctggcttagaaataaccattttcattctatttggatggaatcaggttaagtagatgttctaaggtccttgaatttctttcccatcgatctgtcttgatgtcattgacctttttcttgttgtttctgtctgtttctaacagattttcaagagcattaaaatgatgtcgagttcatctgagacgttggaaaagaatagtgaaaattctgagcagaatacacgggaggacagtgaatatgcaaggctggttgcaccaaatgagtcaagaacagttgacattaattctcaagaggcacttgagaaatcaaagtctaaatccttcatctggtggataaagcttttatcctgttgcttgcttctgatactacttgctttcacattcgtgaaatggggagtcccatttgcttttgaaaaggtagttccagcattagcccatgcgccccccgccacccacccctcttttttttttttttgagtttctgactttgttgtccctataaaatgtgaaagcaggttgctcatgtggccttttcttcttataaagaagttcagtagttgggctttaaaaataaatctcatatccaactttgatgagtgcatttgcatgcatttttacctgatctgaagcaaaccttgacaaaatttttgagctagagtgtgattgtataactctttgatcctgaatctatatcaggcaactgataaccaccggtttggatgtgattggttgttcaaggagatgcaacagtccatggaagctcctagcttctaatagttggtggaccctgccaagttaaagatctaatctggtcatcaaagaggattcttgttgaagagtggcaatagaatgagcaatttggtaaacattgcaggtgttctcttgagagatgaccacagaggtcattccagacctcatgggcagaatcagcatacataatgctactgtcagtatctgtgaagatgaatcaagaagccaagaataaaccatttgattgcaactttcccattgtgggaacagttggctgttagattgaagtttggagaggggattcatcaaaaaagaaaaaaaaaagaagaaaaaaagaaaaaactgtattgctttttggccatgagtaccattttcatggctcaaaaccaggtaactttagttgtcattagtaagtatttgagaaactagaacattcccaagactatttgaacggtggagggaaaatggggatatatctgaattcatacctatgataatcatatggagaagaagtcactcaagcagcagatttggaggtattagatggtgttgctgccgcgaaggatgagaaaagatgcagatcccggaggactaaatagagaagagaatagtcaggatcggctcctattccataattgaatgttgaatgtagtatgttttttgttgaggggtttgattttaaacaataagagaagaagagggtagatcatgagaattgcaggttatggacggtatacacacttaaaggattaaaagatatagatggtcgtgttactatataatcaaatcttctggctggtctctccatgtttattaagttttattactcagcatgttttttgagcatccagtacatgtagatgcagatgtgctatgtgcaaaatcactgctggttatttctttgatgttcatttctttaactttaaatagggcattggtcttgtctatgtttgtgtgcttgcaatttgtctgggtgcggaacttgtaattttttttaattttcctttttaagggtatcgcttccagctggtcatgatatggtatactctcatacataaaacaatatatggaaagcctgtgcaattatgtgatttcatgatgtactgtcgcatgaatattagaaattcagtacacataagaaatatatcagtattaccttcttgcaacctgtttttagtatctccaatatgcttcttcaatcctctcattcagcgaggtattgaaatttatctggcttttcctcttataggaggaaaaaagtaatgtcaatctcattttagtattattatctttttcttacatgtactagttcaattgaataattttgtaggttctcctgccaattatgcaatgggaagcaactgcctttggccggcctgttcttgcccttgtgctcattgcctccctagctttctttccagttgttttgatcccttctggtccctccatgtggctggcaggaatgatttttgggtatggtctcggttttgtgataatcatggtagggactacaattggcatggtattgccctatttgattggcttatttttccgtgaacgtatatatgtaagtcctctcagttccatatggctaccttcattctagtatcaaggatgtctctcaatgaacttctatatttctgtttcataatacagtcatggctgaagagatggcctcagcagacagctgttcttaggttggctggagaagggagctggttccgccagtttcgagttgtcgcactgtttagaatttcaccatttccttatacggtcttcaattatgctgtagtggtgacaaatatgagatttgggccttatttagttggttcaattgctgggatgattccagaagcttttatctacatctataggtcagtgagttttgcatgattggtagaatgaatatatgtttccaaaatagcatttgaagccaaaaaaaaacaaaaaaacaaactgtggaaggtttattgaatttcttgtcatttgatctaagggcaaagacaaacatgtaactaggatatccctctctttggggagctaatgcactcatgtcttcgaaccacattgatagttgatactgcttattaggtacctcgtttcactttttatgcatttgtctaatatcttcctttagcaacagggacctcgatattgaagtaagactgctataggctcaaccgttttccctcataatttacgccactacatgttttaaaataataatatgttgtatgatattgtgcattaaataacttgaacatcagaactggctaacctgcatctccgggcatgtttgatcaccaggccaggcttgtggtggattttgagtattttccttttaccaaggaaaattgtaatatttcttagcagctttattctcttttctaaaccaccttttcttttcatgttctggagcagtggacggctaataaggactttggcagacatgaaatatggcaattattccatgacacctgtggagatagtctacaatattgtatcctttgtcatagccattgtcataacaattgccttcactgtatatgcaaggcgagctctaaatgatctcaaaagggctgaaggcattggcagtgcaaatgccgaccaaggtggtgcttcggtggaactagaaaagcttccacaggaaagaccatggatatactcttcctcaagtgataatgtatgagggagaatttggtgaaaaaaggggggaaagaaagagaaaagagaaaggacatgttaaaatggcgatatgtgatgtctgattcaagccatatatttcttatagaaaagaagcctctgcatgtataggagaagaaaaattttaaaaagccagcagcaatcatcagcggaagttaggaatgggatggtgagccgtgacagaatttcgctcgctcgtgtattatattgcatccatgttttgtatatccagttttcagggagagaaaattaaacatttgccaattagcttgatgagattgttgtttgtattaaaagaattcaactttgttgatacatgaatccaccttgtgttaactgggtggtccttggtggaagttctgactcctgagtttgagccttaggtggtgcggccccgggactttattcccttgctcttaacagaaaaaaaataaagaagaagaaacaaaaagaagaaagagagactttgtttagaagaaaaaagaatgactttaggttctcattgtatgctggattggatagtaccacaagaaaaaacagtagcgctttcagtccaggtggtactttgagtttgtatacactctatttattcgcagaaaatggttatagattcagcttttgtcaagatcaggttaatcggctctggcctcgaacatattacggctttaagacgatatagagcaagccttactagtgacaacgtggactcgaaagcggttcatgcgctttgcccatcttgtccccttctggaacctcctagcagacgaagtgagacccaagtacatcgcttagaacactggatcctgtctcgttcagctccaagacaaaaccacctcccacatccatcagcaatgagaagcgtcacaaacagacgaatcaggttgccttcttgatgtcggtaagtctaacaaaacgttaatctttttttgtttgtacatcaaagcaatgaatcactagagagaacaattattaattttatattgcattatacgaaagacttggtgagacatgctgaagcggctggtgagtttagatggccaacataaacataagggtgagaaacctagtggatgattaaactcaaaaactgattgcgcataatactgcagattctgcaagcacatgttgattccaacatgaaactgaagtcatcgtcacttctgatgggtaacattcctggcctggtctggcaatgcacttgatcttacattgatggttcattgatgttcctgcaagggaagattctggtgaagctaaccccatatgatataactcctaaggctaagtactggaaagtaatatgtgctttccgagcaaatacgaaattacaccaggcaatattatcatccagcagtcgtatacatcggaataaactcttaagcacacagcttaagaattgatgtggccgtacaaaattagccgcattagtggcaccgtcggtgataaatgagacatagcatgtctcatattggaccacctcagcatgcgaagggctgcatgtgatagtagtgggaatagattttgcctttctatccaaatgccctttggagcattaagaacataggccaaaggttcaatagcaagtattttgatccaaactgaacatcaagaggagatcctataaaatgtgcatggaaaaaccaaggaacacaaagaaggcctctctctctctccctctcacacacacacacacacacacacacaaatgcatatgctgcttcaatattctgacttcaactgcacaatcacaatgtctctggttgtacgaggagctgcagctcaattgcaattggcaattgtagagacttgtgctgtttacaccaaaaatgaataaagatttcaactaacaacgataaaagatagatcgggcataacaacaaatactcagcctgattcttcatctcataatacatgacgtggaaaatcttgatataccacttgtcatctaagaagccatgtaagaggacattatcatctcccagggataatttttgtagaaattgagtatcaacagggagggaatacttgaaagatcaactgccttgcaactgtgggagttattcatggaagaagccaccagtaactactgttcaaaagtagcttgttgctggaaataattactttgtccacgtaaaagatgaaaaagagataatttgggaagctctttcttcaataacaatatatacggttatatatcaaggctcctttaccatgtatcttaggcatagcatgtaatgttaatccttttctctagagcaaaggttcaatctaccatagaagtttctttatgttcccaatcattttgcatagtgttttttcaatcattgtgttttctactctcttgtaatggatgaatcctaccatgtaaccctagttatgtatgacaatgatgattactactatgaggatgaaataattgttgtgaagcattaaaggatttcaagttcctaaaacaactaaattatctgaaagttaatgggagaaaatggaacacagactcatgcattcctaagcattcctaaaagaactacctcagtaattcatactattgctgagaaacttctagatcgcaagcaaatattaaccctttgatgccgaggcatggaaaagaatacgcaaaggtattgacaactccttacatcgaccaaggcatgcctggccaatttaaaagaatttctggtcagcgaaccttttattccaagtcatcaacaaaaatattcatccatgttgacttacgacttttgtcttaacaaaaatatacattttcactgattcatgagggcaaaatacacagtgatcccttcttcctcttctccatgaataaatcccatgttggtggatgcctttttaagcagcttttttaatctagctaactcccattttgtcatcagttcctatgaaaacttgggagatgagacttggcctcttgcatggctccttgaatggatgacaagtggcaaaacatgatttctccatatgtcatgcattaaaaaataattaagcaggtcaaacattggtcaacataatgtcatcaaccatttatcatagttagtgggtctctacttttattgttcagtgtagataagtcccaaacataaacttgattgatctctgtctttttttatttaaaaaaaaaatcatatcttatagcatttgtaattgtatttccatttggttgactcaggatttgtgccttggacattaatatatgtcctcgaatgaagtctggtccttttcctcctcccttatacacctaagttcaagcttcctctttactctaatgtttcaatccttcttacgagtggtcctcagggctccaatggcaaccctatctttcacaaagttagcttgataattcagcattgtagaataaacctggttctggttgtactatttcctcaaaagttagtacttcccataaaaatggccccaaaacctaggaaaatgctggcagatcaatgcatgtctttgagcgaattaatatagccggacatgattaggtaatagttgagcaagagctgacttttgaattatgtctttcttcttgctcaactgtatctctgataatttgaggagtattctctagattggtcaaaaaactagttcaataaccagtatctttttatcaatattatttgcagtgtaatgcttaaatttactttaggctgcatttgggtgcagatgtagatcatataaattcaaaaattttatatgctggtgcatattgtttttcacttaaaactaaaccctatttatttgaaatactcaccatatatcaagattttgtgtatttcagatgagagcttaacatttctttgcactagtttaagatgagttggggaatctctcttccacccaagcatgcatgggtgaattccaaggaaggcacaatatgaaatacttgcgcctgctaggaatttatgtggtagcaagcaaatcaactatccatttatctccaattttgtcacccacttgaccagctaaaatatgttagttgtggggaataacatacgaataagttgatggttagtaaggcacttcacaggacattatgcacactgctggacgcatgattagaaacattctcttctcctagctgtttggcaataaaatccagttgatttacacttgaagaatgaatagtaccaaataaaatttcatgcataatgttttttagaatcatgttgtgctaaaataaggtattatgacttgcaatcaaacatccaatactgcagtttgctgttttattcagttatttgtcacatggtggaacttcgataagctatataatatttcattagtttcaattattaattggagtccgctattgagcaagaagttatgatttggtttatagcatactgaactaggagagctctatcatttttagacttgttttcaagacccttattatacaccagtaacagcagggaactcaattcgatacagattgtagattccatcactatgattacttctctttcaaatcacctggcatgacattaaaacctcaaggttgatgctttccactacaacaaatttggctattagcgacggctaattattgtcgctaatagtcattttaattagcgacggcactccatcgctaattgatggtcggaaaaatcctagttggtattagcaatgacatgccttcgctaattggtggttgaaaaaattctagtcgctaattgcctttattagcgatggatattctagccgccactaatacgctaattgatggtcggaaaaatcctaatcgctaattgcctttattagcgacggatattctagccgtcactaataacaatattagtgacggcattagcgatggctaaagtccgtcgctatttattttgttatttttaaataaaattttaaaaaaaatttaaaaaattagcgacgactttgttatcgctaatgctgtcggtgatatttaattttattttttaaaaaatttataataatatttagttattagcgacggctaaagctgtccttaatgccatcggtaatagttaattttattttttaaaaaattataataatattttttaaaatctgttttaattaatcataatcaattatggttcctaacacctgttatagttaaaattcaaagataatatgacaatcacaaataaaaaactaattatattatattatattaaaaatataaattatataaatttacaagtagtatcaaaaaaaatataatacatcaaaacaaaagaaaatcagcctagatcctcctcctcgtccttttcctcatcctcctgctcctctccagcagctgatggatgagtcggatgtcccaaaatccccaaacgaagaaaataaaatattattaataagtttcaatacggagacgtatctttcgatatggaggcgtatctttcgatacactcctccgattttcgaacaaattatttctacacgtttcattcgataatacagaactatagacacccccgatccatcaattggatagttagattgaatttctagcccctagatcctcttctttgattcaagcctaaatatgtaaagcttctaaatatgaaaatttaaaacaagtaaaagagtttactaataagattacctgatatgatggctgggacaacgagcccagctagtcgcacagctgcagatcccgaagaatctccacaaatgtatcgcggacggcattctgaagctctgaggtcgctggctcagaagcctctgcatgacctccttcacatgcgcattgctccaagtctgggacgtcaaggcctatgagaacatcgaagagtattgagccgctggagggtcgaagctgtggccgaatcctatgacccgactcctactcacccctccgatgaccctaagccatccctcaagatcaagaaggggctgagtggatgggtcatcgccgtgccgcgcaacaacatactctgcataatccgcctatacagttaagacatacattagttctaatatacatatcagatcctgtaatgacttaataaatatagtttaaaattcttatcgcgatctgtcgcgatctagaatctaaataatcacaagttctcctagactggtgtgtggcctctcataactgtagctgacctggtggatgacctagctgccatatctacaataagtaaataataaaattaaattaattaaaatatatatataagaatttttacagttctaatgaagaattttggtatagatttcttaccaatctgtcgaccacaatatgtgtgccgaaggagctgcccgtgtgcctgatcgaagcctgctgggtggtccaattttgttggaccctctaccctctaccgtctcctggcgtactcctcaccgcttcactggtcgcagagggcctctcatacgtccgctcgcatccagtgattcctgtaggactttcaatccgatggtgattgagaattgaaatatttgatgacggactgtcgtaaactgtatagcccatctcaaaacctacgtgtggtcatctgctcgaagatcgaacggccagcctcctcatcctgagataagaatcagtagtactcctgcaagtagaaacaagcatgtattaataaatagaatacaaacccatcacgaattattaaattaaatacctttgacttatcagaaacattttccagactgcattacgagcccccgacggccaattggagaacttgttcatcagccccagcatcaatcgtcagatgatcccagtaatcacacaaggtatggagctctctgtaaatgtgctgcaaaattgattttgaacaataaatgttagactctacaatgactaaattttaaacatattcaataaagatataatacttacgatcggctctgaatgtggatgagctctttatcctcaggccgagtcaaaggtgccacgagccgggcgagtcctctaccatgcttctgcatctaagagccggtcgctggtgcgtgtgactgtggggtcactggtgaccccctgtcatccgaacctgagcgcaaaacatctaatataaaaaatattatatagttagtaaaggataaaataacataaatgagaatatctaaagtgttagagtttaccgcaggatgtgagaggtgcagaatcttgcgagctggctgcatgataactctctcctcgagagctctgtcctccgctggcacgactccggcctctagaagatatgatgtataatctctaaaaataaaaaataaatagattcaccaaattaattatacaattatagatgacaatgtaagatttaaaatgattcaaaaattatatacttagtaatactcatcggcctcttcagatatctagtacccttcggattcttctttcaattcttcctcttcttccacttcttactcttcttccagttcttcttcttcctcttcttgcttcttggataggattgttctttaaaacaaaatcagttggatctacctcctcatattgaccatcatgtacgagaattcctggagcatccaactctgtatctattgaagaccaatgaaatcctaatgtttcatcctcttgaaagcattctgataattggggctctcctttttcaaacgcataatgaacgactggagacttaaccttacagtccaccaatctttccttcttctcttccttgatggaaaaggagtatatacacttaagcagcttattgggttagcacaaaggggttattgacatatgcttttgatccatatttgatttcaataagcccatgtcgtggatcaaccttcatacaattatcaatatcaaaccatcggcacttaaacagaatgacactattatcacctaagggatagatcaacttgatcacttcttcgagaattccatagtagtcactcttcgcctctacccaccagcaatcttttatatacatattgctgttcattgtacttttatgttctctatattgctgcgtgtgaaatttgaaaccatttacattacaaccattataacatgtcacatactttgttagcctataacttaatgatcttagcttcctagatatggaatcgctgtctttcatgacctgcatattataaaaaaaataaattaaaaaaaataaattaaataaaaagacaatagtcgaaccaatttgcaaaattttgtgagcactgcatgaaaatttcttcctcgcttatcatcggattgtcccatcttagcatctcatcatattatctatacatgcataagataagtacatgataaatgattaaagagttaagattgtgatggatacttacttaatatatgggttgacctccgtgtagtttagcaaaacatgtctatgcctgtcgaagttcagtattagtcaatacccgacgaacttcatgcccaaatttacgagcaagataggcaaatattgagatctccacctttgatcccttactaccatcatcatgtcgatccacttgagtcagctttgtctgcacactaaagttaaagtagtatcgattgaaatttaaaattttttctattatataagccttcacaatagaatcttcgattcggaccttgtttttcattttttttgagactgtgcatatatctttcaaatggatacatctacctatactgcattggtccccccaccctaacttcatacgccagatgaatcacgagatgctccatggagtcgaagaagctaggagggaatatcttctccaacttgcatatgatctctacactgctggcctcaagactgaagatgtggtcgatggataattcggtagcacaaatatctctgaagaaaaggctaagcttggtcaaagaactctatatggagttgagaaagagatcacaccaagccgatggaagtaatcgttgcatgaagacatagcagtcatagctctttagcccatataatctgcaatctttgacattaacacaccgagctagattacttgcataaccatctgaaaatttaagacttttacaccattcacaaatgtccttcaactatttctttgttaagatataagatgcttgtggcttcagaaaattttcaagtgacacctcaaccagctctaactgaggacgcttgcatatgttcttcatatctgctcgagtcttaggattgtccttcatcttgcccttgacatccataatagtgtagaaaatattatcgaatatattcttctcaatatgcatgacgtcaagattatgacgaataaaattgatggaccagaattcgcagaagatacttcgcttcacccaattaagagttctaccaaaaactccgaggcttctgcttatcaaatagcatgccaaactggccatcgtccaattgggatacgctctgaaatatttccataccactaaggtgcggggggtgcatgatccttctctatcttattcttcctgaaactatcctgctgctttcgaaaaggatgatgcttggaaagaaattgacgatgacaatcgaactaacgggacttacatgctcaagctgaaatgattttgtattctccatgcaatagggacatgcaaacttcccatgagcactccatccttacaacatcccataagtaggaaaatcgctaatggtccacatcaatgtagtcttcattacaaaattctacttcttcgatgcatcaaaagtatgtatgctatcagaccataagaattttagctcattaacaagaagtcttaaatatacatcaatgcttctaccatgatatcgtggtccaagaatgactaatgtaaaaaagatgttatgctttttcatgcacatcccaggcgaaagattgtatggagtaataaagactgaccaacatgaatgaggggccgctgcatgactgaatggtgtaaagccatctgtagatagatctagtcggacattgcatgattcctgagcaaataaaggatggcaagcatcaaattgcttccatgcctcgctatccgacagatgactcatcatatcgaagtgcttgcaaattttttttttgtgctatctcatctgtctgacagtattcttggataaatagagcctccgaagcttaggagtgagcagaaagtatcgaagaaccatacatggtatgcccttctgatttttaccctctagcctcaacttaaatcggctttcaccacatacgtcacatgagctctttagttggttctctttgtagaaaagcatgcaatcattacagcatgcatcttctcgtatcccattgcctaactcttttaccattttctttgaagcatagaagctcccaacaagcttctcatccttagatagcatcttctttattattgctatcatcctattataacaattcactgtcatattaaactcaaccttcatattcaacaatcctgacacagctaataaaacagtgtgttttacatccagccacaatggttcacagcatatggtagaaatcgccgctgtcagcttttggattatcctccacatcccagttaaattcaggactagtcgcatccataaccatgtctaccattctatccatgtccctgtcctgctcgcttctaactcttgcaactttctcccacgtctccccatgcaggtactaatgcttgtagttggcataaatccactcttatacaaatggacaataattgtatctctatcaaacatttctctattgtcacatctgttacaagggcaacgagcccatccttgatataagagtactgcattttcaaaagcaaaatcacagaagtactctacaccctccctatattcagcaaaaaccattctgtcaactactcgacgatccatccaactatggtccatggcacactatctaaaaattctgcataaatataaacacaaagcaactgttaattaattattttatcatttaaaatggcttacatagtaaatacatcttatcatcaactaatatgtatagaaagtcctaacccattcaagaaatgtattaattctatagatcaattacaataattaaacgatacacaacaggggccgaaaaaaattttgacagtatttttctttagttctccccacatgactgaagatgtgtgggaagaactaaaggacacgactgaagatgtgcggggagaactaaagaaaaatactatccgaaatttcttttgaatccttgacatatcgtttgattactgtaatgacctataaaattacttgcatttttcaaactgtccatactagacaatcaattgaccaatatacataattctttcatccatacaaaatatataaatatacggatacagtagaatatgtacattaatcaaaagacggatctatgattccatgcaatgcaaatttttttaaaattaacaccaaattaattacttaaattaacatccaattataggataccgtagaatatgcactctgcccttgcgcgaggactggctaccctggacatcggctgggacccaaggcctgagcatgtagggcgtgccccgaccccatgtttgcaatgctgcccagcaccttccatcggcctaagcacacaaggcgcacgagggctggatgccttggacgctagttgggacccgaggtccgagcatgcagggcacggcctggctccatgttcgcaatgcatactgaccggcaccttccctcggtttgagcggggctggatatcttggacgccaactgggatctgaggctcgagcgggcagggcacgccccgactccgtgttcgcaatgctgcccggcaccttccttcgatccaagtgctctgcatgccgagacccaagtcccgtacttctaattaattaattaaatatctaactaattaattaaattaatatttaattaattaatttttaatacataaataaacttaattaacataatttaaataaaaaaataacttttagtgaccgcattagccatcgttaatactcacaatagaaggcggactggcgcatagagactgaagggcgagaaggacgactagggacgaaacactagagacgagggcgcaagaaggcagtgcgggtcggggcctcgaggttaggtcggcggggcagggccgcgagctgggggcagcagggcggggccgacgaggtcgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactaataaccgtcggtaattaattaattaattataattatgatcgaatttttttaaattctcaacttattataattataatttttttatttttctccgaatatggtatgattttagaatttaaagcgcatctttaccgttcattatctaaataattatcgttaaagcaccgtcacaaaagaccgcctcgatccgatagccctagatatgttgatcattaaaattcaattttcacagccacaaacgactgcacgatgatctgatagatgagaccatcgatggatccgaaaacttacaacgatgatctcgatgatatttgtaacacactatctaaattttacttcaatcggacatcattatcatggtcaatttagcacaggatgatttgagccgttaaataaaaaacgaatgatcaaaagactaaatggtgtctgattataagataattttttagataaatgatctttgctactactttgatcgtttgtatggtggtgatcgtaaaattcaaatcgcgtatatatgaacgatcaaaaattctcttgatactcattcttaaagtcttttaagtaattatacttgtgcttttataagatctgcttaacatcgatggtttatatatatgtgcaatttgaattttatgatcaccattgtacaaacaatcaaagtagtagcaaagatcatttatctaaaaaatcatctaataatcggacgccatttggccttttgatcactcattttttatttaacgacgtaaatcatttcgtgctaaattgatcatgataatgatgtccgattaaagtaaaattttgatagtgtactacaaatattatcgagatcattattgtaaattttcggatctatcggtggtctctatctatcagatcatcatgcgatcattcatgaccgtcgaaatcaaattttattgatcgacatagctaggactaccgaattgagatggtcttttgtgatgatgctctaacgataattatttagataatgaacgatgaagataattcttaaccatcggtaataaatttaataaataaataaataaaaattttacgacggcaattccatcgctaatagtgccgtcgctaatgattttttaataaataattttttttattgtcgctaatattctttccaccgtcgctaataagtttagtaaataaaaaaaaaatttcttttatgttttgcgaagatgaattccgtcacttatgattattagcaatgacatattttgtcgctaataatcttttggccgtcgctaataagtttaataaataattttttttttgcgatgacaagatccgtcgctaatagtgccgtcactaatgataattagtaccgtcgctaataagtttaataaataattttcttcaataaatatttttttttacgacggcttatttttttgtcgcgatttttattgataaaaatggttattagagatgacaaaaacgttgtcgttaatagctgtcgataaaaatattattagcgatagagatattatcgtcggtaatgccatcgctaataaagattattaatgatggcaaaaacatcgtcgctaatggccattgctaataccttaatttcttatagtgttcaactgataaaatcaaatagaggactctcatgctggaagtgacacattagtaggcattcactggagaataaaaaaggcccaaaaagttgaaagcaagagtccaatggttgctacaaaacacatgcccatacaacatgaattaagtattacaactgaaatgtatggggaggcaccagaaaactacatatttttaaagtttctgccttgatcctcttccgttcaaggatcaaatttttttcctagatataaaagcattttatgttttatatttcttttacttttacaagaattaacaggaatcttattgttatacttctataatgtgatgaccttcacttttgcttgaaaggaaatgtgaccgacagatatgatgaaagtagcaaacctccataaggctatctttgtcatgacttaggacctcatccaagatctattcagtgcataaccaatatggaagtaaacacagacccacatgtgtcctagcatcctcgcctggttaagggtttaaatccgttcacatctaatcacgagcatcatgaccatcccgtggtcagctccaataggcttgtgatgtagtgtccctaattcatatgggctatgtgtcgggtctactttgatatcattttcacgacttagtatcttatccaaaaaaagctaaccaaaagatattatttagatttcttggtactatatagatatctaagatccaccaaatgcatagccaatatgggattaaatatatgtgcgcacagatcctcacaattctccccttcccagtctcgctccctttctctcctcctggcactctcttagctccttgttatattcgtacttcatattctttttccacacttttttacttctcagcctgtcaactgatctgttcccaaaaccaacattaagatcctgcataattagacttcccatcccttaatactctccatgaaaacccagactcaaaccagactctaaatccactagccataagccactaaaccataggttgggcctgataacctagtcacttgtccactctctgaactttcccgatgacctgctttgctttaacaaacttagccactatctttgccagataacctgaacctgaatttcctagatttcagctttttagatcgatcgtcatttccctagtactatttcgttttataaatatgattagaaaatcctgcaaagtattttgcaaccctagaaatccaatttaatgcactatcagaaccatgctttgccttactctaaaacccttaccctagaagatcaacttcaatggtggaaccaagagttttctcttgggtggccaacgtagtgactactaaaaatggaaaaagttgattgtaaagtctattgtttattgataaatttcaaagttagttttcctcctcccaagggagggaatcctatattgttttcataaattatgactctatagtgccaatggttaaattatgtacataaagaatatatagaaaaacaaagacaaaaaccacaaaagaacaggtgttagcaccagagtttaaaagaagcatatgcaagagtatctagatttactcacgctaaaaagtaaatttgatagattatgcaaaaggacaagtcaaattacctggaatatcatgcagaataacatgacctacatgtgctacaagtgttcaagattgctctctcacatgggctgttctttggcaatattgttgctcatttttataaaaacaaatgccactttctttatgtggaataccagaaaacacaggagtgggactataatatttgatagtgatccaattgcaacgacaactaagaggagctgacttgggacttaaaacaaaaaacaataaaaatgtcataaaaattcaaaacacaacaaggtgattaaaaaagaaggggaacaatgaaaataaatagaaacaagggtgaaaatcttcacctacttctttgatcgtataagaatgggtgcaagaggagagttgtaatgacatattgtaaataagttaaacatcttgcttcgatggaaaacttctctacttgagatcggaataaggggaaaacatcaggcttcgtttaattgtctgttaaagaagaaaaagaggatggacttgtaaggctgctgctttgttgattgttttccccaacaaatctatgtaagttggattgtccatcaatgcttgatcttagtgaaatttttgagataggaaaatgttctcggcatgttgatctaatctagcattcctgtgatgaatttgaaggagtatatctgatctagcacatacacaagtttttacacatcaagtatgcacaaagccatgcaaatgctaacccacaaaataagattcattgaattttcgtctttttctctctcttggcatttcattttcattggaattgggaaaggatgtaaacttctagtgcccatctcttaggagattcagaatacttggtgggtggtgttttctttcttttcagcttgtgctttttattttgtcttcacatttcaggctgatggctaacttttgcaccagcctacattttttttagatgaacaaacctcttattacttgcacaagcctataattacttagtgaaccctgtctagtgtcatttctagacatccatttgaccacatgtcattagaaatcttcaacgcctagttgtaaacagaagccttaaaatcacaaaaaccattgtccaagcctcatcaaattagggagcctctggaatacaaatgtcattaagtctaggaatgacaggataagattttatgaccagccatggcagtattcctaattttcaaccagttcatggaaagaactgtacagtatataccatttgacgagcatataccaagacgacacactacattgtccttttttagtgtgttaagtcttctggggatgataaccacctcaaattgcatcattttggctagaattggaccacttcaacagctgtgcctccatgcagtgactcacaatcctcaccgacctcaggcataattaatgatgccacaaataatttgggccatctagcttgtggaacatctaaaatgtaagcagccaagtgatcaccaccactggaaggatgtacatttgttctagccgctgtaaatgtttcaaatgtggtaccaacttgtggaactcatcattttgtaacctacactttcctaaacctatatatttactttgctaaaattcagtactgatcgcataatggatcaccgagaagtaggaaagtgcaacattgtaagacataaaagatcatatcgagaaatatatgatagtctgttttgacaagtctagaacccatccatcaaaaaataaatgagccaagaaaggcctatttttagatgattagtggggaggcagaggagaggaggggagaagagattagaaacacacaagatggggagaaaaggggggtgggtggggagcatattcagatttacacagggccacaggaaggatgatgtttgtatcactgaaaagggtgtttggtggcattggatagatatctaagaggaatgtctccttggctttgtaaactgtactacagagtgcagataagtagtcaaaaaggaagaaacgtcacaggaaatctaaagagaaaggaatgatgatgtacagaccggcatgaaaatctatcattgaaccacaaaaatagtaatggcatgggataagctgcgagataaagcaacaacaagttaagacgctaaagagagcattgaggtgaagaagtaaaagaccatttttattttaactaatatgattatggacccatgggaagggtcaatcaggatatttaaacagcatgagagatgaagtgagaagtacacaaaccatgaatctcactgaaatgggtgactgatggcacttaatggatatcaaagaagcatatcgcctttgaattttttggtgaggtgtaatcatagagtgttgttaagcaatcaaaagggaggaaatattaccaagtaagaataccaaggaaggccaaatgatgatgtccaaattccagaagtacaagaaactctgtcaacaacttacaccagaaaaagatgctattgactctggtcttgaccttgcatagcctcctaacatggcactaataaacttatgctttagaaggggtttggcaaagtatgctatctgagtattaaatatcatatcagcagtcaccagcactagaaaagaagataaatcagtatgatgattttctcaacatttatctggagatacacaaaccaaaataaatattcaccaaagtcaatcaattttatctctgtacttttattcagcaagaaaatatctctttgaagacagtcataacaacaattatctcaacaaacacatatgataatagttacatatattatgaagacagagaatgtagcctttgacaacaatgcctggtagagaagggtttgacaatgtcccagtataggccacatgaaatacaacttgtcaaaaaatgtttttatgatatcaattaatgtacattttttttaaattttaaatagaggtaacttttgaatctataataataggaagaggtcattcagaaaatctatataatataacataatttagagtaaattttaacccagggttcccaaataccaaataataaagcataagagaaataaacttctggaagaacaacttagattatcggaaaaagaaagaatcctcagaggtgtacagcaaggaccttcaatgaagggaggcgaaagaatcctcagaggtgtacagcaaggaccttcaatgaagggaggcgatctttgaagaagtaatccttcaggcagtagcagaatttacatgcataaaagatgggagagcatcatccatgttgctgcaatatgtatccaaaatacaatcagttggaaaagttgcaattaaaatcatatagttgataaacataagcattattcaagactttatctgtccataagaaaacagaaacattggcagatcacttggtaaaaaagtctcaacattttgttgacaggttcgccatgagaattcacattattagcccctcattgtacaccttgatttattcacattgtggtttactcccaaacacttcagtcatcacataccaaaagcagcataaggtctatcattcagaactttctacttctatcagctgctcttagatgcaacaaatctacaagttgagttgtcagttgtcatcttcacccaggctaacaaaataccagtttatcctaatgctggaatcaacataactgccaaattatacactcattcagactaacttttgtaaaaagcatatatgacagttgcgtctgcatcccttcttaaaacaaaatgatacatctaagagttatttcagaaacagagtgaaatattaccagtctttttggaggtgtaacagctttctgctatttggcctccaacatcaaacaataccagaagagaaggaaactgggggaaatgggaaaggacgaaattttagccacagtacgtccatttgtatccctaattttcttcatttcttcgcaaaaaacaatagaaagggggaaaaaaaagattgacgattaacaagaataaaagaaaattaaaaaaaaaaatctaataggttggaacatgaccactccggtataaaagggagaatatcatgaaaaatcggaagaaaactcaaagaataatattctatatatggaagaattttacctctcttacaacatgaaaaaaaaaaaaaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagagaatttacaggtatcaatcagaactctctttctacaaagcaaacaaacggaaaaagaaaaaaaaaatatatatgcactctatccctctcaaaaaaagaacgactcacgaacatcgggagggccttgttcgacatccaatttctccacctcctatcactaaccagctctcaaagaaccacccaacaaatctgggagactggttccgaaacccaaacgatcaggaatcgccagagagagaatctcagatgatcaagatttgcatcacgaaacccaaaaatatcatatcctagaagaaaaagaagaaggaggtaactatacagaagaagcagaatacaatcctcatcaatttcaatttcaatccatgatcgaaatcaattccttatttgttgttgtctgggcggtggacattgcagtccgcggagtagaaatcgttcctctcgaggagagacctcacccagtcgtgataagaggcgggcttcttctggggatcttcgggccggagaggcgagccgggagggatcggaggggcgttgaagcataggatgcagcccgtggggacagcgtcgtaggccggcgccggcgttctcttcttgcgcctctcaccgtcgccgctgctccggtggcagagcttctcgaatttcttcacggggaagaggagcgcctgcttcgccttcctcttgtaagaagaagaagatcgtcgcttcccgttcctcctcgctctctcatcgtctgtaacaccaccgccgcataaggccaactcgttttccgccccatctccacctttttctctttcttctgtgggtggttctcctcgatcagacatataacgcccgccgctctatgcgctagtgccttatttatctatcagtcgaacagagttaataaatgaacaaaagaagaaaggaggaacctgcatagatggatggcaacatctaagaccctctctatctttctacggatagatcaacaagaggaagaagtgaaacatttacgatgagagaaaacgccgccctagaagatctcgttctctgcctatctatgtactcggaacaaacaaaacaatagcagcaatctgtgagagagatcacgccaagggggagaggttgcgggggtggatgaagaatttcccggttttgccggagaatcgggtggatgtgtgtgggtgaagaaagatggggaggagcatccgattccggttcctgcactcatcattcaggggcgtctctgtattttatagcgtatatgaatatatatgtctataaatcatttttaaaaggttacatcatcatttagttgcaaccggttcacattttgcccttagcaacaaagtaatggatcagttctttaccaaaatatataaaaaaaaaaaggaacagtggagttgtccgctcgccgcggcacccaacgccacaccctatccgcaaacaaagccgagtaaggctactaaatttaaaacccgagggaagctggaattttttttttaaataatatttttttaataaaatatttcaaatttacggatggttggaaagtattttccattccaccgtgccatgtaaaatcgtgaatataacccataatttcttaactatcttagtaggtgatatgacccacaatttcacgatcatcttgataggtgacatggtgccgttgaaatcatagatttaactcacgacttcaaccaaatttaaaattatgaattctatccataaatttttttttttaatgataagagatgcgcagccatgaagaagccatgcgggcatcggggtggtggtgcgagcaggggtaggggggaccgcgaggagaggggcaatgttgagccagagagagggttgagggactagagatggcaaaattaatctgacccgatgggtatacaccctacccgaacttgatcaaatccgaaaaatagggtttgacaaggtttggataaaactcgaaaattatagtacgggtatgggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttgtggcatacggtgctagaggtgggggcggcgggtggtggtgacaagcgctggaggggcgtggatcgcgagagaaaaggagaaacgatgaaaagaaaggaaatggtatcgtgggttgagtctatgatttcaaatttttttgatctacgtcggatgtacatgtggacttgaaattgtagattgaacctatgatttcagctgaggtggcactggaattatgggttgaacccacgatttatgtgacacagtaaaataaaaaataattttcaacccaccgtagtttgagaatattttattaaaaaatattatttaaaaaaaatgaaaaacttgacctggcttgtaccttttgtgtgaaagaaggatttccattccttcatgcgaatccaccatgagatcccatattgatcattttaaaatctgtgcaaatgatgaatgattgagtgtgaagtgccctgagatctatgtgatggatgattcaatgatggattcatgcaaaaaaaaaaaaaaaatctctcttttgaccttctatgctagatgggatgtatgcatccatccatccatacaaatcttagaacattccatattctatcatccattcatctgcacatatcttgaagtactatattatcaatctccatctagttgcacagctctcaaaggattctatcttttatcattcatcaatataaatagctctcaaagcatttcatcctctatcatccattcatctccacagatcttaaagtacttcatcatcaatcatttatttgtttgtataagtttcaaagcactccatcctccgtcatttatctacttgtacaaatctcaaagcattctatcctttgtcatccatccatctatatagatttcaaaacacttcattttttactatccatctatatggatctcaaagcactccatccttaatcattcatctgcttgcctagatctcaaagtgttccatcctctataatttgttagcttacacaaatctcaaaatactcttcctcacatagatcttaaagtactcaatcctctagcaactatctacctaaatagatctcaaaatacactattttttgttatccatctacctatatatatctcaaagtattcaatcctcgatcatccatccatttgcatagatctcaaagtgctccattctttactcttgcatatatctcaaaacactctatcttttatcatctatttaccttcatagatcttaagacactccatcttctatcattcatctgcttacacagttctcaaagtaatttattctttgtgatccatctacctcacagatctccaagcacttagtcccttattagtatccactagtacggatttcaaaatactacatccatgtgattccctttttctctcaactcatgccaaaacaagtcctttgctaaattaataagaagaacaattttgaaattttataaaagtttagttatcatattcatctgataatattttataatagagatagacagctgaggtatattgcaacaaatttaaagttttattgattaatttataatttttaaaattttgatgtcatgtaaataactcaaatttataggagtatttctataattttattttgttattattattattttgcgagggagtatgagtcacggggttcattagaagacccaataggggagattgaaatcaatcaaagaacatgtatcatcatcacttgcagaatcgtgaaccataaagcctgaagaaacatcaatagcatatgttgtggaggttatccaccatccgatccaacatctcctcttcggattacgatcgagtacttgccgttgagaaggcttcgaggatcggggaaagacctgaggaaccacaacaaagcaaccctacatcatcgacttcgatttttgcttgacctcctaacccgatatttaccgaccttgagggtaggatcctcccaacgatgaagagcatagtcctgcatacctatgcaagtgccaacctgaggcaggaccttggcttagcatcaaactcaaaagattgaactatttattcatatgggagatccttggaatctcccaatagaacatgggcatgattagcatctaacatccatgactaataattctgaccctagttccttgctccaagggcctgatagattgtagcctaccaaccgaagggattaggggccaaatatcctatcggatttcagtgtgatagcttatcatgccatctctatatgaagaggttacaaggggatccccagataagctcaatcccaaaggactcttctttgctcttgttctctcattttttttattgttcttaagctttagctgacttaagcattggaggatctccaccaaaaaaatcatgataattatggattgctcttgcagatttccttttgcactttgagcctcaaacggtgcccgaccccaatcatatccaaatccatctaaaatcttgcagtaatagcatgacgctagaggaaaggccattagttcgattgaagagaaaagaaagcatgacaaggatgagagtacacaactctgccgcctccctccgatgatcatctcgccatagccactgcaagaaaattgattattagcaatggccagatgccgtcgctaataatagacatgcaatcgttaatggtattagcgacacaagccgtcgctaaaaaatcatcggaagaaagctcgatgctgaaggtgtatattagtaatggcaaaaataccgttgctaataattagtagtagtgacggtaattagtgacagctttctgtcacttataatatttttttttaaatttaaattaaaattattttaaaaaaatattagtgatgattttttccgtctctaataagccatcgctaatagtttctttagtgatggctttatcgtcgcaacagctatcactaatgataagtttttttaaaaaaaaattagtaattatatttgttaagacctgttataatttaattaacaagtaattatatttattaaaattaattataattaaattaataagtaatatatatttatggatattataacaactaataattaactatcaccatcataaataaaaaattaatattatatattatattaaaattaaattatataaataatattgctcaaatatcaaatacaatacatcaaaactaaaaaaaaatcaatggagatcctcctccttctcctcctgctcttgtttgttctttacagcagtagatggatgagagtcagatgtttcagtatcttgtaatgaagaaaaataaaatattattaataattttagaactaaattaattaaaattataaaattaaagtaattgatgcatctcaagtctaaatctttatgaagaaatatattttgatatactatttcgattctcaaatagattatttctacatatttcattcgatgatatagaactatagatatctccagccagtactctatcagatggttaagttgaattttgaccccctaagtactccctctctcccgcttgaagtctaaaccggtgtgaagggatatatttcaatatactccttcaattctcgaatagattatttctatacatttcattcgatgatatggagctatagacacttcagacccattcattaaatagttagattgaattttgatctcttgggtacccctccctcccgcctgaaatctaaactggtatagagagatatatttcgatatactccttcgattctcgaacggattgttcgtacacatctcattcaatgatacggacgtatctatacctccatcccatctatcggatgggtagattgacttttgacccctagatctccttccgactcaagtctaactatttgaagcttctaaatataaaaatttaaaataaaaaaaaatttattaatactacttgatttatctactgtgatggcagtgacaatgagctcaactgatcgcacagatgtgagtctcgaagtatctcaacaatcatatcgcggacgacgtcccgaaagctttgaggtcactggcaaaaaaatctctatacgacctcctcgacatgtacatcatcctatgtctagatcgtcgaggattgagagaaaaacatcgaagatcagcaagttactggatggtcgaagctatacccgaaccctatgtcccagctcctactcactccaccggtggccctgagccatccttcaagcttcgaggtcaaggaggggctgagaggatgggtcctcactatgccgtgctacgacatactctacataatccacctatacagtttaaaaatttaataatactattatacatataaatatatataaaaatttaataaataatcttttaagttaccatgatccgtctggatctagaatctaagtaatcatcgatcttcttagactggtgtgtagcctcccacatctacagctactgtggtacataacctagctatcatgtctacaaaaaataataaaattaagttaataaaaatcaatatatgatcaactaaatataagattaatataagtttagaatttttatcaatatatctactataacatatgtgccaacggagtcgtcggtgtgcttaattggatcttatcagatgatccgattttgtcaaaccctttgctatctatcggagtactccttattgctccactagtcatagaggacctcctatacatcccctggagctttgtcctttggagctctctcctcggctagtgtggctccatcttttaggagtagttatcttgtaatctataaaataaaaataaatagatttattgattaattatacaattatgacaagtaatgtaataattgaaatgatgcaaggtaagtataaaaagcaaataaaataagtacaccacaaagataaaaatgactccatatgtcctgagattgactccaattattcaagagtcgacttcatctaccctgggttcaactcttgctacgtgctagtcttctccagtgtgtcagagttgactcctttatctttggagtcgactccttcctttctgggatcgactactcatcggtctcttcagatgtttggtatcctctggattcttattcagattcttcctcttcttcctcttctttttcttcttccacttcttcctcttctttctcttctttaccttcttgaataagattgccctttaaaacaaacttagtatgatctacctcctcatgttggctatcatgtaggagaatttctgaagcatccaacttgcatctattaaagactgataaactcctaatgtttcattcttctgaaagtattctgataaatggagctcttcttcttcttcaagctcataatgaacgactcaagacttaattttatatatagcccaccaatctttccttcctctctctcttaatggaaaagaagtataatacactggaacagcttgttgagctagcataaaggggtcgttgatatatgcttttaatccatatttgatttcaataaacccatactgtggatcaatcttcatataattattgttatcaaaccattgacacttaaatagaataatattattacctatggtcttagcttcctaggtatggatttgcccccttgtatgacctgcatattataaaaagaataaattgagagaaattaaaataaatgaaatgacaatggtcacttaccaactggtagaaccaatttgcaaagtttcatgagtgctgagtggatattaattcctcgcttatccttgggttgttccatctcagcatctcatcatactacctatacatacataagataagtacagaataataagtgattgaagagttgagattgtgatggagacttactcaatatatgggtcgacctcctcaaagtttagtaaagcatatgtcactacctattaaatttcagtatcagttaatatccaacaaacctcgtgtccagattcatgagcgggacagacaaatattgagatctccacctctgatccctcatgaccaccatcatcattttgacccatttgaatcagctttatccacacactaagattaaagtagtgtcgactgaaattagaaatttcttcaattatataagcctccacaatagaaccttcgattctgatcttatttttcactttcttcttgagactgtgcatgcatctttcaaatagagacatccaccagtactacattagtcccctgaccctagcttcatacatcagataaatcatgaggtgctccttagagtcgaaaaaactaagagagaatattttttccaacctgcatatagtctctacgctgctagcctcaagatcggagatgtagtcgatggatagtttggttgcacaactgtctctgaacaaaagactaagcttagttaaagaactccatatgtgattgggaaggagattatgccaagccaatgaaagtaatcgttgtataaagatatggcagtcatagctctttagcctatagatctacaatgtttgatattgacgcattgagctaaattacttacataactatctaaaaatttaagatttttatactattcatatacgtccttcaactgctctctcattaaggtgtaagatgctttcagtttcaaaaatttctctaaagacatatcaactagctctaatagagaatgcttgtatatgtttttcatatctactcgggtcttgggattatccctcatcttatctttggcatccataatagtataaaaaatattattgaacatatttctctcaatgtgtattatgtcaagattatgatgcatcaaattgattgaccagtacgataattttcagaagatgctgcggttcacctagttataagttctatcgaaccctcaagatttttgcttgtcaaatggtataccaaattggacttcgttcagttgggatatcctctgaaatactttcataccactgagtcgcaggggtgcttcaccctactctattttattcctctgaaactgtcccgctgctttcgaaaaggatgattctcagagagaaattgaggataacaatcaaaccagcagggcatatgaccatgctcaagttgaaatgcttttgtattctccatataatatggatatgctagcttcccatgagtgctctatcctgacagtatttcataagcagaaaaattgctaatgattcacatcaatgcaactttcattacaaaattctgcttctttgatacatcaaaagtacgtatgccttcgcactataaaaattttaactcatcaataagagaccttagatatacattaatgcttctaccaggatatcgtggtcttgaaatgactaatgtaagaaagatgttatattctttcatgcacatcccagatggcagattgtatgaagtaataaagactggccaaaatgaataagaagccactacatgactgaatgatataagtctatcagtagatagatccaatctgatattgcatgattcttgagtaaataaaggatgataagcatcaaatttctttcatgcctcactatccaacggatgagtcatcatatcggtacttgcaaatctcttctttgtgccatcttgtccatctagcaatacttttagacaagtagagcctctgaagtctaagagtaagaaaaagtatcgaagaatcttatatggtatgtccttttaattcctatcttctggtcttgacttaaatcaattttgaccgcatacgtcacatgagctcttcaattagtcctccttataaaaaagcatacaattattacgatatgcatctatcttttcgtatcccatgtctaatcttttctcaattttttttgaagcatataaactcctaacaagcttcttatctttcgatagtattttctttatgattgctactatcctattataatagttgatcgtcatattaaactagatcttcaagtttaacaactctgatacaactaataatatagtgcatattttatatcctgattatagtgatttatcagcatctctcagtatacgataaaaatcatcactgccagcttctagatcatcctccatatctcatttaaatttagaaccagcagcatccataaccatgtctaccattctatctgtgtccttgtccagctcatttctaacccttacaactgtctctcatatttctccatgcaagtatcaatgcttatagttgagcacaaattcactcctatataaatggacagtcattgtatccctatcaagtatttctctattgccatatctcttataagggcaataagtccgtccttgatgtaagagtgccgcatttctaaaagcataatcacataaatattctacaccttccttgtattcagtagaaatcatcttgtcaattacttgacggtccatgacacactacctaaggattttgcacatacaaatacaagataattgctaaatgattattttattatttcgaatggcttatatagaaattacatcttgccatcaactaataggtatagaaggtcttatctcgttcaaaaattatattaattctataaatcaagtacagtaatcaaatgatatacaataagaattaaaaaaaaaattgacagcatctttccttagttctcccccatatggcgtaagatgtgtgaagagaactaaagaaaaaatactgtctgaaatttttttcaaaccttcaccctatcatttgattactgtaatgacctataaaattaattgtatttctcaaattatccatactggacaatcaattgatcaatgtatataattctttcatctgtataagaatacataaatatatagatactgtagaatatatatattaattaaaagatggatctatggttctatgcaatgcaatccttttaaaatttttaaataaggagcttcaaagtatcgagcatcgttacaaatggggagggccaagacgtgcgtcccacacatgtagacttgggtgcaccagatgactagaccgtgctagcacaccagcatggcatctaggcaaattccatcctagagattccaaagtaccaagcaacattgtaaataaggctagaaatgaatcggactgggcctgaccacacctctgtctgagtctgatctaaaatttttttcgtactttagaccaggcttaggccctaaaatcttttaaaatatgagatccgagcccggctcaaacccaatcagatcggcccatatcatttgtaataggttggaagcaagctcatcagcacttgccgtccgagtcttaccgattatccccaagggatagatattctctatcggaagtacattgatcatcgaagaactcactagaagtacatttgtcatcgaagaactcactaagttgcttccaccaccatcgaagtagatgagcagggtagagtcggtccgacagtggcctgacctcgaactctattatcgaaggtaatggggctactctcatcagagagctctctggagtggttccaacctcttaagagcaccactagatgcgaggttttgtatggtagtagtgctcatccagatcttgtcagtgatcgagaatatactttttgtgcataaattaaatttaaatattataaatttaaataaatctaataaatctaaatttaaatatatatttaaagaggagagaatggcatgtggcgatggtgatggcgacgccgtcgctaatactcaccaagtggcgcaaagaagaagaggagacggcgtagagattggggcgtgggtctgatggtgcagtgggggaagaaggggggaggcgaggggagaaagggggaggcagggcacggtagtgggggaagaaggggggaggtcgggaagaagggggaggccaaggcaccaggatgagggctccgacaagtttccaacatcactgggggaagaaagggggaggtggggaagaagggggagggtgcgggctcgaggatggtcaattcggtgcggggatgtcagatccaaggaggggatgacagtgcagggatgggggctttgggggtccgacgggagcagaagggggaccagaggtgggggaagaagggagaggtgatagaaaatgaaaccaaacgattggggatgggagtaatttttagggcatagtattagtgatagctaatttgcatcgctaaagtcttcactaatactaattatttaaaattaaatttataatgatgcagaaaagatcatcgctaataagtcttcacccttataatgatggatttaatttccatcgtaataagtagttgataaatattactattagcgatggcttatttaccgtcgctattacactattttcttatagtgagctggagtagtgccatccgagagtctaccacaatgtaaccccaagctccagtcgatccacagccattacaggccctagtctaggaaatctaaatgctgatttgcatggtgtagtagctctagcaagcaacggagtagtctttgaaaaaataataccctacaagccaatcacatatgagatatgatgaaattttttttatattttatcttccaaacttatgtatttgacattgttaattaataaaattggcttttcgattcattatatgctgcatcttattattgttttaagattataatgaatcctataggtctggacaatgattttaggatcacaatgagatcacgtcaatgagatctaaatctttgatagtcttaacctaaaatattttcagtcattagttcattgagtcagagaccaatgataccgataagactggcacgtcctatgtatgctcagtggtgaggatggttgatcttataactacttgtgtagtgacactaatataaaaatatgggtgctcattagtgaatgagttcactgaattgacctacgagagaatatctaatggagtcttatttacatgtcagctgattgttctttagtgaaaattgtgcaagcgatcctttgacctgagatcaccatggtaccttatgtacatgaatccatattttggttcactttctaacttgattttttgatctttatgtagggtgttctggatgtagtgaagtgtgtatggagattgtgagtggtcaataaggaatcaatcactcctaataaagagagcgaacatcctatgtgatctcataggttgatgattctgaaaaattttggccaaagcaggatgataattagaaagaaatttttaatatatcatcaactgaattatcaccttctgattgaaagcaattggacttaatatgatttcatgcctacggctcgtttgggatattgtttgactgaaggattgaattacacagtaacttgccactgaaggatattttgataatttttatcaaattttatctcttctggatagtcataatattttactagacgttaatattgatttatgaacttattagaattaaaaaaatttaaatcaaaaattaattagaaagagttctagttaattgagatacttgagctgacctagtctgattggattagggttagatcaagagtttgtgtctactgctagttagatttgaaatctaatagatcacacactttgaaatttgatcttgatctaatttaattagaatttattataaattttaaaggttaatttgatatgctagcatattgtgttaacctaagtttccaattaagttaagtttaaagtatttaagcaaaactgaacctgttgcctttgacctgattggcttaggtctatttttattgaactcctacctaacttggaagagttttaagtatgaaaagactcctccatgccaccctagttttcatgccaaaataaatgccgccaccctcatttatgcattaagaagaggaagagtccttcttctttaaagactcttatctatcgctttattttccatcgattcctttaatgtcacatgccaaaattaaataaaaaaattataggatgcagaagagaaagagtcattctatatgaagcctcttttgtgctacttaattcatcagagaaacaatttttctatgtgagggaagtggagtgtcaagagttggcaccccttgggtctccttgacacctcttcattttctatttaaatggggtgcctcttatgggataagggttgagaattgataaaaattcaaagatcttggcatgtgataagggagaaaaaaatctataaaaaatcaaaagaaaagacaagaaaaaattaagtggaaaagatagaaagaagagaggtgagaaaaatagcaagtgaggtatgcttgtcctaagatttgattttttcatatgttggagtacaaaatcaaatcttagattatgagacttttggagagaattcttttggtgtgatcctagtggagaaattgaagacaatagtgcgttggtgtgatcattctttaagaaagaagctggcagtgttcttataaagaaacggctgtagtggtgcaccatttgggaaggatcttgaccatctttcatgtggatgaccattgaaaaacttctactttagagtctcatggagatcaccttcttaccatattatttatttgaggaagtataagtttctaactctttgcatgcttggatttttattttgttcgacatctacaaggtgattctagggtttgagttttgatttgacagttttaattgttaaaattttttatttatatattaaaatttttaaaattcttattctactacatgaccgaaatctaatagtcttgatccctaaagttgccacaccggatggctccctcttggaacagtcgccagtctcaccctgggagcccaaaatcgctccctagcataccctccactctgtcctcacctttggtccctacttgtcaccttcccatcatagcctaagggaggaagactgatggcgataatcctaatccttctcctccagtagggactccactccaaactactccccaccccctcaaaaattctctttaggaaaaagagctcgagtagaaggtctaagacattgagtgctatcttggcgaagtcccagaatgggagtaattgaaatgacgatggtcttagcttcatctctcggtccccattctctcacaatatcctgagggaatcgattctggatcgattcaagatgcctcaggtagagccatacaatgactcttcggatcccctcgatcattaggagggctataaagccctcatgatgcttcacggtattttagacactctcttttgctttggcttcctagctacccttaagaaattagcacgagcatgctattcgaaactccacccagaatccattcattcttttgaacagcttgcaagactgttccttgcccacttcagtaacaaccaagcccagatgaagaatatcgatagcctcttctccattcagcaggaagagagcgagtcgttgtgtgaccaggtggcacacttcaacacccccacacttaaattgtgcaacctcgatgagtcggtggttatgtcagcactcaagtgatgacttcagaatgagtacctcatcttctctcttgataaaatatttttgacagactatgccaacctatttgcatgcgctcgaaaatacacacaagaagaggaagcccgggccatgcggaagcaagctgaagggaagaagatccccaataagaagtgaggccaagaagagcctcatgtgggcttgatgggagaagggctctctcgaccatcgaagagcctcaggtcgaggagtcccctcagcacttcaacaactacaccccctcgtcaagatcttgataaaaattgaggcttcggagatatctttactgaccctaatcgataaaaaccccatcgatcaggaggagcaaggagaaatactattgcttctactataaccatggtcataactctgaagaatgtctctgactcaaggatgagattgaagtcctaatccatagagactatcttggaaagtatgtccgaccgtgtcaggcccgaccgtctgaggagctatctcaacatcagttcgatgaggagaacaatgacaaccgacccatggatttgctagggggtgacagaagatttgctagggggtagacagatagtgtgcaggaaactttgcttcccctccaatgaaaacatcctctactgagtctggcaccttttgattatatcaataaaaatatttttctttagactctattacaggttttctatcaaagtgaatgcatgaaacaatcgactgatattaactatcaagaatgacctagcatcataagaagcatacccaagacaaccaagtgcagcctcggtcttcggaggatgacggttgaaaaaaatccaatgtgggatattcaaaccctggtgacaaggttgaaaagcaccgaactcatgcagatatcgcgactgcagctaagactttcataattctaaccaacgaggctctggtcatgagaagaaatcctgactcaagttagaacctcaacagcaagacctcatcaggatcttgtcgaacatcttatagtgatcggattaagatgacaatagcgacttgggaaaattatcacggattgactggatgtcgacttcagataagatatcattaggatcttttcgaacatccctatagggatcagggtaagatgatgatggtaatttggcaaaattatcatggatcgattggatatcgacttcaaataagacctcatcaagatcttctcggacatctccatagggattgggttaagacaatgatggtgacttggtgaaattgctatgaaccgattggatattgacttcggatgagatttcatcaggatcttcccaaacattcccataggaactgggttgagatgacaatggtgactttgcaaaattgcatcggatcaattagatatcgacttcagacaagacctcatcaggatcttttcgaatatttccatagggatcaagttaagacaatgacggcaacttggcaaaattgtcatggatcaattggatatcaactttggacaagatcttattgggatcttcctgaacatccctgtagggatcgattaagacgatgacggtgacttggcaaaattgtcatggatcgactaggtatcaactttggacaagatctcatcagaatattttcgaacatccctatagggatcagattaagatgacgatggtgacttgataaaattatcataaatctactagatatcaacttcagacaagaccttatcgggatcttcccaaacatccccatagagatcaggttaagatggtgatggtgacttggcctcatcgaatgagtccaggttcactatcgacggtgttactcctaaccaacttcgaacaccgaggcctcaacttgtggtctgagccaaggaccccttccttatgagcagttaatcaaaactatgactaagttggttgagcaagcaaaccggtgtgggaaataggagtcatttaacacaagcatcaaaaaggtaacaaggaaatccattctactagaaaaagtccattacaagaaatttactatcaataaaaagggagaaaaaggcaaaattacaaataaggctagtcgaggtcattgtacgtgggttcggcagaatgttcagtggcctcccgggcagggcccctcacaatgttcttggcagcaaggccaggagctgggtcctcgctaggacagactggtccttgagcgaggcaggctcatcttcgtctgatgagaacacctcgacctaatcatcactatcttttgagtgaagatggctcaagtccaacttgggaaccatctgatccaagcgcctcttacaggcttcaaagccgtatatgtaggccattgagaatcatttggcaacctcatccttgaactctgtcaaagccttgaatttctcaaagcccttgagtttggcctcggtagcaaccttcattgtctcctcttagccttggacttgatgagctccacactatcttcggtagtcttgattgctgcttcctcgagctctaggacctcctcaagctcagccgccttctgacgaagtaccccgatggccccacgctcgatggccactaggccctctagggccccgaccttctccttgagctgccaggagcttggacctagcttaagtggcctcttccttagttgccccctcacatatttggtcgtttgcctcgcctcctcaatggcctgcctcgcttcctccatagccttcatacgggccttggatgccctaaacttttcttttagggagagcctcatccggttgaagttgagctggccctcactcaggatggttatgtcatgcactaattgcatggaagaggaaggattagcaactatggacaaaagatgaagacaattatgaacaacaaaggacttatgccgagtagaccagtgtaggaagcaccagcaacctcatccaagggatgagcctttctctccgactaatcagtcggcagcaaaatcatcttcaccaactgtcaagcgagctggtggttctaaagcacagagtcattgctttgcaccctccttactatggtgctgaactcccctttgctcctggaccagaaggggcccacctcataccttgtttgcctcctcaaagctaggaaagatggtggctatagggtagatcaaggtggagacgatgttcgcccatctattgttaggggaggggaagcttggccagttgatgggaatggtgactgagctaactctaaaatcatcggtgcgacagatcatggcggctcgaccaccactggttcatcctcaattttcatggggtcagcactcgacattcctacgaatagtgctaaggtcagagtgggggtaaaaatcctcgattgggtactcctcgacttcttccatgaagtctctctactagaggagcccatcttcctcttcaacaccagcttgatggatgaaaaggtcggcctcactgctacaaaactgaaggaagagcagtcaattcaagttctaacaatggtcaaggaaattctctgaaccaaaaaggatgtcgactgcatcctaagataatgatgggctaacaccaatgtcatagatattttgctcgggtagcagttcctttagctcaagcacctcggcaaatcgagtggactttgataatctttttcatccttaggaaggatagacttgtcctcattaggagacaagtagggatcatcccaaaccaagctaaacccccagggctgatctaaacacatgcaaaaaaaatggttcttccattcatgaactgaggaagggagcccaataatgttacatcctaatcaaggaaaaaagtaccaccatcctctcttatgaggatgcttcttcaggatgaataatgctttgaagggagaacaccttaggacaatactgagccagttataaagaatgaagaaaataatgatcatctgagcagagtttgaagtgatctgagttaaaaggatcttatagaagtcaaggacattattaataaaaggatggaaggatacttaccaaaaaaagttggaaggaaaggtgaagaccaatccgaagggattcctcttacaatgcgactctaccttttgaagctgcagtcacacggccatctcaaccctagactttgagccaaaattctaaagagataggggattgagaatgaaaccttctcaggtcatcctcagtaagacatgacttttcattacttgattttcaaaaatctccaaacctacatatgaggctacccatacatcgccatatgggggatgggcatttagatgaagggccagtttcgacggtggtccgagaggtgctctcaagcctggctcgaggaggcggtgactgagaattctgactgccatgaagattttcacccttgacctcatcatcattagaagacatgaagaagaagaagctattgaatgcaaaagacagaaaggatgaaaaaaagcagaaggggaaaccaaaccaaagaaaagataaagaacccaagcaaaagccgatggacaagcgagagaaatataatggaaggaggaggatcgattggagactacaattggagatcaccagcatcaaggaagatgatagtaacaaggactgtctttctattgaaagcaatgataggggaagagttggtgcaggaaagaaaaatatgacaaaagcaaaatgggaggaaaatgatagaaggcctacttacaccacctactaacagtcaagattcaagccccgtgccattagattttgacacctgacatgcattgaaaataccaaatcacatgattcttcatcgcaccaatcccagagcgagccgcataggctaatccacaagacatgatgtggacctaccaacatacgacacatgggcaatcacaatgggcccaaaagtgacttctatattttcctctgtgagccattatgatgcgatgccatgagttgcccattcctcataaatgtagtgagattcaagaagtgatgtgttactgatgccctaggattttcttcaacaagtgctaccgactaaatatctgggagagagaaggttgggtcggtgatcgaagaactagtttggtaattgactatttccttcatttgaagtaataaaatcacttcggacttgagagtggggaataagtattgtagaggttatccaccatccgactcaacatctccttcttagattatgatcaagtactcaccgatgaggaggctttgaggattagggagagacctgagaaaccaaagcaaagcaatgctacatcatcagcttcggcttctgtccgacctcctaacctagtatccactgacctcgagggtaggatcctcctaatgacgaagagcatagtctgacagacctatgcaagtgtcgatccgaggcaggaccttggctcaacatgaactcagaacatcagaccattcatctacatgggtgatccttggaatctctcaatagaacatgggcacgatcagcatctgacacacatgactaacaatcttgacctctgagttagtggatacgttcttaactccaacaacctgacaaatcatggcttaccaaccaaagagattaggagccaaatagcctaccaaattctagtgtgatagcttatcacactatctctatataaagaggtaacaaggagacccctaggtaagcttaattctaaaaaactcttctgtgctcttattctcctattcttttttctccattattctcaggctccaactgacttaatgttgggatttggtgcctcgaatttgatctatagaagaaaaattaaagatggaggagcttagaacgcagcgcatgatggtgcagaggcccagaggcatagcgtatgcaggctcacagtagggtgcggcctacaggatgcatggcccaggcatgggggcggcccagcacgagtgcgcaggcgcacgacccagcacagggaataggtgcgcgcgcgtggcccagcaggattttggtgcggtccatggtggaccgtgggagttgtcgtggtccatgcgactgtcatggactgatgcagtgtagggagaaaatatcgcagcttataactattctcttcacggtcgaatggctaaggagtgattcgggtgatgttttgcatgatcagagggttcagatggcttgcggtcatgatcaaatggacaagaatatttttaagtcctaatagaggttgtatttctatctgcaatgggttttggacgcttgaggggcagacgggccgaaggacagaggtaatgtcccatggaacaaagagtagttggctggagtcggtagtgagcacctaagaggcagaggagctataaagagagtcggagcagcgaccagagcctcaggtggggtcgaaagagggtcttcttggtttttttatgagagcttttataagagatgagaggtgagagcttcttattgaaagaaagaggtttgagagttgagagtgtatgatctcttgtaattattttctattatagtgaagctttgcatgccccatggagctaaaccttgatctaatctacgtatttgattctcttttatttcttctttctttttactgcaacaaatagtataagatctccaacaattagtatcagagtcaggttggcaccggagtatgcgatttatatcaaagccagatgataccaaagtcgtggttgcagcagtgttgatcaagattgaagaagatgaaagagtcaggctcaatcaaagtagagatcaattagtatgatgaaaaaagtaatttcttcctatagcaagcgagggtgaaggatgcgctcatccaacagggattaatcgatactctcttatgcgaggagaagctgactaccatgaaggtgaatgattggagacgtagtggtgagcatgatttatttgtacttgatggatgatgtagtgattcatgtgcttggtgagacttctccgacggtgatgtagatgaagcttgaatagatgtacatgatgaagtcactcactaatgctctcttcttctgaaagtagttctatcagttttggatgagcgagggatagagcgtgcaggagcatctcagcaacttttaaaagattttcactgatctccttagcattggtgagaaggttaaggagaagatcaggatgttagtcttacttcatcactttttttttcttttgagtctttaatgactgctcttcttgtgaaaaagagcgccattaggatggattacttctatactactgcagaatgaggttctcagattgaaaaatcggacttcgagttcagatggcgactcagctttggcaatgactggagatggtggtggcagaagatgaggtagcaaaggatcgcaatgtaaacgatccaagtccagatcgagagattcaagcaagatcagatgctaccaatgtgattagttggggtattgagttaaagattatccgcagctcagagatcagatgaagactactgtggcaatggtaagtagcaatatagaaggcagtgacgatgttcttctagtgtcagatgaggtatctacttctttcctttagtagattttaaattttgcatgtttgtatcatatatgttacaaagaggagctgtttaacatcttagaaagtagtgagggcactgttcacttatcggataaattgagttgtgagatcaaggacagtgggacggttagcttacaagcacatgatggaatagtgaagaagttggataagatccaatacgtacccagcttcaggaataatctaatttcatcgagcagactggattcaagcaatacagatgcagagctaatgatggaatcctgaaggtcatgtatggcagtaggattgtgatgaaagaaagaaattatggaggatactacctcttggtaaaaagcttagcatgagatagagctttaggagtcagtgggagccttgtgcgaggtagagttctaggagtaggtggatcgaacacgagacgggagactcagaaggatggcatgcaatatcgcaaggtgaagtttctattaccataagaggctatctcgagtagattgtaggtcaggaggatcacagcacataacagagatgggatcgagcggtctggctcgactttcatatttgtccattcatggtggtaggcttatgccctaggacatggggacgagatcatccagaagctctcaaagttagatggaggtcgaatatcgagtcgagatggagattgttgagatttggcatctcgaattcgatccataggagaaaaatcaaagacagaggagtttagaatgcagtgcacgatgatgcggaggcccagagatgtagtgcgcacaggcccgcagcagggcacggctcgcaagcttgtgcaggcccgcaggacgtgcggcctaggcatgggggtggcccagcactggctcgcaggtgcgcggcccaacgagtgctcgggagcaagggtgcgcgcgcatggcccagcaggattttggcacggttggaccatgggagctatcgcggtccatgcgatcgctgtggatcgacatggtgcagggagaaaatataaaggctcacagctattctctgtgtgatcggacgactgaggagcgattcgagcgatgttttgcatgatcagagggttcaggtggcttgcggtcatgatcaaatggccaagaatgtttgtaagtcctaatagaggttgtatgtctatttgtagtgggttttgggccctcgaggggcagataggccgagaggtagaggtaatgccccatggaatagagagtagtcatcgatagtgagtacttgagaggcagaggagctataaagagagccaagcagcagccagaacctcaggtggagttggtagaggatttttttggattttttatgaacgcttttgtaagggatgagaggtgagagtttcttgttgaaagagatagatttatgagagttgagagtgtgtgatctcctcttataattattttctttcatagtaaaattttgcatgttctgtggagataaatcttggtataatccacatatttgattgtgtcttttttatttcttctttttttctgctgcaataagtagtaccaaatctccaacactaacgagtgcggactactatagtaggttcctcttttacacttcgagcttcagacagcacccggccctagccgcatccacttctgtccagagtcttgcagcaacaacacactttatgatgactttgatgaagtaattgagtgatcgtggttttttctttggtaaaatagaacaagaacacttaaacaagacacctataggtcttgcatctgccatgattaaattggctagatctgaaggtagctcggaattttttagcttttcttactggctggtggaagcttgcttcctttgccaaacaatctatagtttggttcccttatctaagaatatggttgcaagagaaatgttgaaggcattgagtagtagcaatgatattatgaatggctgggtgtaatgaagaagactttccatttatccaattggttattgtagcagaatctctctccaggatcagatagtcaatctgctagttttcgatagcagcatgaagtccgtgccatactgtcatggcttctataattggaacagaattcaattgcaagggaactgaagcagataataatataaggccttgatagtccctgatgacaaccaattctagaacgattctgggttagagaactatcaaagttaatctttaagaaatccggttgtggggcctgaccaagagatgaaggtttgttgatgagaatcctcaaagagatgtggaatgcaacgccccaaattccagttccttttaattttctgctgttgttggctcgataccactcattgaacaattgctatgcaatgctgataatgtttttagagtctcaaaatcatgcactgcatgaattaagggcccacttcctaaatctgcttgcccatgatgggctcaattaagcaatccaacaagccctccatggcgtgttacagagttcttgacaactagcccatgaattggcccctaaagttgctcaaataaagatgataatggatcagatatgaatcagatcagctaatacctatatccatcttataattaaaaatctcacatccatacccatcttgcaccctctttgggttagagcggattagataaattagatggtgtggggtgggtagataaaatggttgggttgagttggataagaaaccccataatacctatcaatttcatatatatgtgcgtgtgtgcgtgtgcgtgcgcgcacgcatgtgtgtgtgtgaaattaagtaaacccaagcaacagtcttatcaatttatttagttgaggaaggatcatatggagtagcctggactctaaattttctttttacttagtttataattcccatctaattcactccttggcatttgacaaaaaaaatataaaaagggataagtgggctccaaccctataagttgcttttatttctagttggatcaaatatacgatgcaaaaaaaaaaaaaccaatttcatggtataagatttttagtcatgaataaaaacattttaataaatacaagctcaatttttcacaaactatttttatcaatataatttttaaaatatttaatgtatttggaaaaatatttcaaatcaagatatataaaccatccggtccctttcagcctttttgagcatggccatgatcattctattgtaagatttgaaagagactaatttttgaatataaaatatatgctggtgatcatcctgattggttagatttgacaagaactagctcgtggataaaaaatatgccatcgaccagcatatatcaatgattactcttctggttagatacgaaaaactagatcctaaattggcatgatcataagccgattagagaacaaacatcacaattgattaaacaatgcatattttaatatacaaaattcatttcatgcttgatatgatattttaagattgtttttttatgcagagtatatatgaaatttaatttaaacataaatataaatatacataaataatatgcatattttgaatttcaaatatttaggttattattcaaatgcagatacaaagataagtaatataacattttaaatcagcttatatggcatacatgataaaaatcctagaacagaggcacttacttgcataaggatttgtgtaggagtgtgtttaatcctacatcaactatatattgattgggtcttagatacatataccagactaagtaactcaaataacaccttttggttggttgtgctttctactaagattttacattgttataaatggtattagattgagcttagcgtatggtatatacagactagagaatattgccacacgagcttattttgattgaccacaagctcatcatagtatttgtgattgaatttatggtacttataagtagatttggatccttgagtgggggctgttaaggcttaataaagaaactatgtaaggatccatatggggatataccggctagatattagatatttatataaaattaaaaaattcaaataatatcttttggttgggatcctgatcgttacagtgagccatcataaaatctaaaaaggtctattaccaatttgcctcacagcatggagagtattgaaagctttaaaatcgagatctcatccatcaataatgattagacatcatataacaaaggttaagaaacattatgagtacctcttcaattaagtatcactgtatgactatttgtgagtgcgattgctgaagttgctgcaagactccgattcaatactgatgtgactaaggatggatatcgtttggagaccgaaatgctaaagagaaaatttgcaagagaagttcgctctccccgaagattcttcgtgggagattctgaaggaaagaaaaactgtttctctttggaaagctcaggttgcatctaaaaatttttctattaatctacatgaataaggatcaaatacttacttaattagcagtggaaccagagatcaaatctcaaataatctgatataaaccttcgtgaaggcctggatgtacagaccctctaattcgcatgcatgttagacaccgcaggaaagcaggatgaactctgatctttacaacccactcaaatgaaggagaagatgtgttcgtgtgacatctcacaccagtaagtgggatgcctaaggagggcccatgcccaagggagaaggggcggcaccaaaggggagaggctaaggagaagaagaagggcttctctcttctcacacttctctctctttctctcttctctcaatctgatttgtttgttatttttctatacatccataggtagagaccctctctatttataaatgaatcccataatctaataagtataggagttctaactcaaatatgatttgaatcagtccaatactcatgaaagaaggatttctatatgagataaaattgctatcacttatgacaaccactttgcacccactccctcacccacatgggatgccccaaaccagcaccatttcagatgttggtcagcccatataagagaaaaatctcagtgcaaataggatttctcatatctcatccaaaatggatcctattcgaatctaattcgaagctggttcgaaataattttaaaagactgttaatcccaaattctttaggacttttataccaaatctaacttgaatttttgaactcaattaagcttaattaatttagatctaatctgaaattaatcaacacttaaattcaatctttcatatgctccatggatcatagatcagaaactgttcatccccaagatcgaatctgaacctcatgtatagtgctagctagacatagtcaactcttcaatcctatttgactcataatttaattctcaatcaagttagcttatataatcaatcaaatcaagtactttcaaattagacatataaacatagaccaattcttttctattttgtctgacttgggtgtgtgactccataagttcaaacactaagctggtagcacaggagctaatttctgcactaatcgaaatcctatctagcaatgattttcaatgtttagatagatcgaattatcgtaaagaaatatttcaaaatccatacacatggttactgcataattcgtccttttgatcctgaatgctttaggatggtctcaagttaactgtcaatcaagattgtttcatccatattgtatttcaacctttcaaatctatctcatagattgtcctgatcaagactttgctaaattaaaatatagtgatacatcaactctaataattcggaggagtcaatcccatcttgatccacatacagactttgtaagtacttgactgttcccaatagccttccatcactgtatttaaaattcagatagtccgacaccaaagcacagtgagttacttacaagtcactatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttaaatctgaaagatacttatacccatgtgcttcgcgagcaactcttgacagcagaatgctcagcaggtgagtcattagttcagtgacaatgtactcctacatctcatctgtatgccatactagtatcaccacactcttttattaagagaacaaccaatccatatgacacacaatgacttccactcgataaacatcatcatcctgtaatgatgtatcatttgatcacaaatatgtttaagaactatacgataaatcctctctttatcgtacactaacatagttctaaggatttcattatagcataagagttcaagaaagatgttactttatgatgaaaaatatcagaataatttttattcaataattaatattcatatacaaaaaaaatttaatcgtcatccgattaattttaggatataattttcaacaactcccattttgactaaagctaatcaggacagtatcttatacccatcttttatttgaagtcatcgaactctttgatcttgagagctttagtgaagggatcggctaagttctcttttccatcgatcttctgaagtttgatatcacctcggttcacgatctctcacaccaggtgatagcggcgcagaacatgcttggtgtgatggtgtgactttgattcttctgtctaagctatggcactgaagctgtcacagtatagcagaatagagccatcaatagaagatgtaactcctagctcgtgatcaatttttgcaaccataccatcttctttgcagcatccaatgtagcaatgtattctgcttcgcatactgaatcggctgcagtatgttgcttgaaactcttctaacaaatagctcctccattcatgataaatacataatccgatacgcttctactgtcatcacaatctgactgaaaactaaaatcagtatatcccacaagttttaagtcagtgtctccatagataagccattggtctttagtatttctcaaatacttaagaattgctttcacaatctttcaatgcttctcatccagatcagaatggtacctactcactatccctagtgaataggccatatccgacctcgtatatgtcatagcgtacatgatagatcccactaccgaagcatatggtattctactcatgcgctctctctccttaggagttgtcggatattcttttttggaaagagtaattttatggtctattaaaaaatagtcttttttaaaattatccatattgaaccgcttcaacaaggtatcaatgtacgtggattgggacaatctaagcaacattctagatctattcctatagatcttcatcccaagaatgtaagatgctttttttaagtccttcatggagaattatgatgataaccacagcttcatactctgcaaagtcgggatgtcattttctagtaatagtacgtcatccatgtacagcacaagaaagatgactatagaatcaaaaatttacttgtagatgcaaggctcttctccgttcctaacgaagtcatacattttggtcaccttatcaaaatgcatgttccaactcctagaagcttgcttaagtccataaatagatatttttagcttgtacacttttgactcatctgtagatctgaacccttcagattgtatcacatacacctcttctttcagcttttcattaaggaaagcgattttgacatccatctgctagatctcataatctaagtgtgtagtgatagcaagcataattcagatggacttgagtattgccacaggagagaacatcttgttatagtcaatactataatgctgacggtatcctttgataattagacgagctttataggtctctacctttctatctgctcctctttttctcttaaaaatttatttacatcctatgaattttatctcttcagatggattaactagtgtccatacaccattgatctctatggactccatcttagattttatagtctcaagctatttctgagagtcgggcctttacatggcctccatataggtgatcgaatcctcatcattctcatcaagtttaatgagaacaccatcctggatcagaaaatcgtagtatctatccggttgatgcggtactctatcggatcttcttaatggtacttctactggctccaaatttgattcatcaatcaaattcaattctatatgtgttggtccttccaccttataaacttcatcaagtttaattttacaggcattagctccatcaagaaacttctttttcaaaaagattgtccgactactgacaaatatcttttattctacagtgaggtaaaaatagtatcctttaattttctttgggtaccctacgaacaaacatctatcggatttcgatcaaagcttatctgttcttaaatacttgacataagctagatacccccagatcctaaggtgtgagagcaccagcttacgcccagtatatatctcatatggagttttattgacagacttgctgggcaccttattaaaaatgaagcaagcagtttttagagcatatctccaaaaggtgattggcagactcataaagcccatcatagattaaactatgtctaaaaagattcaatttttcttctccaatacgccattatattgtggtgtttcaggaggggtccactgtaagagaatttcattctcttctacatatatcaggagctcactggtgacatattcacctcctcagctcgaacgaagggtcttaatactctttctagtttgtttctctacttcagcatggaatcgtttaaacatttcaaataattttgacttatacttcataagacagacaaattcatacctcgataggtcatctgtaaatgtaatgaagtagtagtatcctcctctagcacttatgttcataggtccgcatacatcagtatgtattagacctaggacatcactgtctctttcaccttttttcttaaaaggtgacttagtcatcttactaagttggtaggattcataggtaggtaatgattcacaatcatctatttcaaagatacgttctttgatcaacctgtcaatgctactcttgttcacatgacgaagcctacaatgccaaaggtaggattcactgatattatctaacttaaggtatttattggctgtatatattatactaacaggccatgatattatgtatatattatattttaattatccacgtataatgacagtattattcataatgatatcacaaaaatcatcttttattataaacttgtaattaagtttgaccaaaaggcctacagagatgacattcatcaaaaaagagggacaataatgataattatctaacatgatactactagactcgaagataagctgcaaggtttccaaggtcaaaattggaacaagactttcatctccaacgttaaggaaccgctcgtcctctcaaaactatctacttacctgtagtccctgcaatgaattgcatatattaataagactttcagtatccaatatctaggtagaagtatcacaaatagagaaattacaagaagttatcatataagtatcttgtgaagcaatcgattgctcctttctcttagttttagacctgtttgggtcaaggatagctatataagcaagatgattctttttttaatgacctagcttcttacagaagaagtactctacttggctcttgtcaacttttgataatttgctctgcttaggatcggtggcacgagatttctgtaccttttttttctttcctctcctagaggatcaatgccctgcaaatgaacctcccactaaattcactggctccttctggagctggtgatccttctcaaaagtctgcagtaactctagcaaattatggtagttcactgcaggcttcgtcattttataatgactgagaaaggataggtaggattttgatagcgaattgaagagatcatccttgcctaactgttcatgtaacggaaagccaaatttactaaggcattcaatctactcaatcatatataatatatgatcgatgattgaagccctctctcgcacacgggcattgaatactgcgtaggaggttttatatctctctgcatcctcaggggtgccgaaggactcgttcaatatttgaatgagctcttctggctttacatcctcgaacttacgattaagttcgtcgttcatagctaccttcatcacacaatgcataatcatgcggttattaagccacttcatataagtatctctcacggtacgaggagcattggctgcaagttttttggatgcctcatccgtaaggacatatacaatcctcttgtactctaagacgatcttcaactttcgataccagctgtcgaagttgggtccaataagcttgtcgctgtccaacagcgtacgaagggatagtgtgttggccataactgaaaaaaaaattaatctattagtatatgaattatttttaatcccaaagatatggactttagtctaaagatttttttactatttttacgaattggtagcctctacctccaactcgaggaattatgctaattccttagtgggtactagatccacatggactacattcgggtccaagtgtggctcggtcaatcctagtgcattcatgggtaggttcataatcaattattttttcaaataatttttagtaattggattttaccccaagcatcccttcagtaggcgtgtggcgccttcactgaaaattttgattaagtccaaccattaacatgacacaccaagtgcatccaacaaatagatattcagaccttagttggttcggccaacctaagcattgatttgaaggtacatcatgatggtcatatgatgaatgataattccaatacgtaatagatactaggcatgtggtgcctccaatgcctatttaaaatattggactcattatcatacatcttaataggaggctatgaccaagttatctcatgactttatcactttatggacctaataatttagaagatttgatttcattgacttgagaataagagaagaagataacctgcaaactgcaaattctcccactgacttcattaagtcatgcaaaggattagacacaagttggtctaaagatatgtaaatcagtcacactgattcaccttaatggcatagatctgtataaatcgactagtgatctaatcaaaatataatctactatgttggtcagataaatgagatcagtgggagggatgtgtccttaactcaccgtagatgcatctagatgaatagctcccaattaaaaatcacttaatcaaatctgtcaaaattaccttagacaccaactggttaatgagttttgatttggttcaccagaagattcgggctcaaccatggagccatgatcatgatccatttattagggtcaaatacatgaacttgatcaaacttcaactattgagattgatttagagaaatactgacctaatccaattcaacacttgattagatttaatcaatttttttacttgatccatatatgtttttaatcctaggtctagcctattagaaggatctgattcatgctaaccctttacccatcattttatgtagtatcttaatgatcttcaattccaaatctagatcattcaaagcttaattcataattaattgtatgaaatatgtgtttcagtctgtagaactattctacaagaatttcaggtgaaccatatcatatgtttcaatccataaaaataaatttttataatatgtttaacaattaaacatacataggtatgatctaaacttcatacatacatctcatgcatcatgataacttttagattaataccgattacatcttatgtaatatgcaattcagatctaaaataattttatatttgaattttatcctattataataaattataaattattttagatctaatctaaatatatttatgatcaaaataatatataaaaatctattcactttttttcttcctaaaattagatcataatgacacccttacacatcataagagaacccatcgaataggcaaaagagagattaatctcttcaaacttttatgatcaaacgatctgataatctcatcaatctgagtactagactattaagatctaaaatctaattttatatataattacatcaatatataattattgataaaataattttatgtcatgaacatattcttgatcttatcaattatgttctttatctaatctaattagatttgatgtatcatatatattatattagatctaaaatatatcttatactgattataaaatattaattttagatttaatattatataaaaaattaattagatgcaaatatgaatgcacaaagaataaatttttaataaaatctattttcgtacagtgctgaatttcaatagaatttagatctaaatatctatcgaaatgaatctaatttagatataaaataaatctcacttcataatgaaaatagtaatattaaaattctattaaaataaatttaaattagattttaatttatgttgttattccatcaaaaattcaatgaccgcagaattctattataacaaacttctaacaaccttaatcaataattgattaggctcatctaatccaatcaaagttagatcaaaaaaaatttatacaaatagattcaaatcagatttaatatctcataaaaaatctcagttacatcttatgtaattaatctcaaaaaaattaattatacatgtatatatttcagacctgctctgataccaattaaagggaaggaaaactatttctcttcagaaggcccagattgcatctaattttttttattaatctatataaataaagatcaaatttttacctaattagtaataaaatcaaagattaaattttaaataatctgatataaaccttcacggaggtctggatgtacagagcctctacttcacatgcacgtccgatgccgcaggaaagcaagatgaacttcgatctttgcaatctaatcaaatgaaggaggagatatattggtgtgacacctcacactagcaggtggaatgcccaaggagggcccacgcccaaggaagaaggggcggcaccaaaggagagaggctaaggaaaagaagaagggcttctctcttctcacacttctctctctctttctctcttctctcaatctgatttatttgctattttttatgcatctataggtagagatcctctctatttataaataaattttatgacccaataagtataggagttctaacttaaatctgatttgaatcagtccatgaaataagaattgctacatgagatagaattgtcatcactcatgacaattactttgcacctactccctcacccacatgggatgccccaaaccagcaccattttaggtgttggttggtccatatgagaggagaatctcaatgcaaataaaatttttcatatctcatcccaaatggatccgatttgaatccaattcgaagcaggttcgaaataattttgaaaggctattaatcacaaactctttagaacttttgtaccaagtctaacttaaatttttagattcaattaaatataattaatttagatctaatctaaaattaatcgatacttaaattcaatctttcatatgctccattgatcatagatcagaaactgttcatccccaggatcaaacctgaatatcatgtgtagtgctagctagacatagtcaactcttcaattctatttgacccataatttaatttttcaatcaagttagcttatatgcttaatcaaatcaagtactttcaaattggacatataaacataggtcaatttctttctattttgtctgacttatgtgcgtgactccataggttccaacactaagtcggtaacataagaatcaatttttgtactaatcgagataccatctagcaataatttttgatatccagatagatcaaannnnnnnnnnnnnnnnnnnnagattgcttcatttatattatatttcaacctttcaaatccatctcatggattatcctagctaaaattttgctaaattaaaatacagtaatatatgaactctaataattcagaggagtcaatcctatcttgatccacatacagacttcataagtatttgactgtatttagtagccttccgtcactatattagaaattcagatagtccggcaccaaagcatacttatatccatgtgcttcacgagcagctcttgacagcaaaatactcagtagatgagtcacatattcagtgacgatgtactcctaaatctcatctgtatgccatatcagtatcaccacactctttggttaagaagacaaccaatctatatggcacacaacgacctctactcgataaacgacatcatcttgtaatgacgtatcatttgatcgcgaacatatttaagaactatacgataaatcttttttttatcatgcactaacatagttttaaggactttattatagcacaagagttcaagaaagatgttactttgtaatgaaaaatatcagaataatttttattcaataatcaataatttatatacaaagagaaattcaatcatcacacgattaattttagaacataatttccaacagactcttcgatgcttaaatcaattagagttttagaatagtagaggaaagagagtgtgaaagggagaggatgtgagagcacactaggcattctctagaattgagtttacctaagagtcttacctctatatgtagaggtggagctgtatgttgtcatgctaaaacatggtaagccgttcagtcctaattttttagactgttaggcctcaatccgataggttgttaggactggagattcacccactaatctgtgcaccaagattgttagtcacggatcgaacattccaaggatctcccaaatggttgagtagtccaatgtttcaagattggtgctaagccaaggttctatcttgaattagcacccatgcaggttgttggactacattcgtcatcatcgataagatcacgaccttagggttggtaagtgtttgattaggtcagacagaagtcaatgatgtaaagctgcttcactttggttttaggagtccttcggtatctgatgttggtccatcggcaagtgctcgactgtaatctgacaaggggatgtcggatcggatggataacccctataacacttgtccctcactttcaagcccaaagtgattttattgtttttgatgaagagagtagctgatcactatactagacttcaatcaatgacccaaccttctctctagaagtttaattgccattatttagtggagaaactcttggggcatcattaatatgctgcttcataaatcttgtcacatttatgagggctgaatggcttgaagtatggtgccacaattattttaaaaaaaggagatctgaaaatcatttttaggcccatcgaggtccaccacatgttgtatgcttttagatcccatgtcgcaccccgtcgattaccctatgtggcttaatttggggatgatgcaatgaagagttacatgattgcatggttctgatgggtgccacatgtcaaaatttagcagtgcgaggcttgaatctcgaccattagtgagtggtataaatagatcttcctcatattgctctccttctattttgctcctatcatcatatccttgcttcttgcactagttgtccctctcttccatcacagttgatcgaaggagggctttttgtcattaccatcttcctcagcattggtgacctgcataccgcaatctccagttggtccatctttttcattttgtttttcttgcttctttgtcgactaccactcacatccttttcctttttcttagttcaatttcctctttctctttctcgtctcttcaatttttttttgcgtccagtagcttcttcctctatatgtcttctgatagtagtgaggctggggtgaaagccttcatggtgatcggagttcttggtcgccgcctccccaggccgagctgagagtacctcttgaactaccacctaggctggctcttcattcgaatgtcgatcccttagaccatgatgtacaagtagccccatatgcaggtttagagatttctggagatcaagcaacaaggagtagtatcttattaaggatgatctaaaaatgtttcatttctcaatttttcatcttctcgatgaaggaaaaattgcctttttcctgtgtaggatctttcagatttcatcaaatctgggacggaataaattttaaatttttatcctatgctattttagatctaatgtctattagatctaattttattatctgatattttaatttcaaaattaaatctaaaagtatgagaaacatagacatacctcaagggtaatctaattatcctgtagatgatcgcagtactgcttgaggttctgatgtagccacgcaagcacctggcctctaccagtatccactcaggtaggatctggaacatcttcttctcatgattctatgctccaaaaatcagatctaaatctgattagaaagatcttcaaaagtcttcctaaagttggagcagtagcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttaactcttgaaaatatgaattaacattctcactaactcaaaggatgtatcacagacacaatgtacacaatgtgatagaagaataacccttttatttatttatagtcaaaattataattttgttcttagatttgtacagaaatgtgtcagccgatctggcatctagggcacacatctaacactcgggtcaaagaatgattttaggatgatcgagcaatgaggagtcatgtctgatgccctggagggtcaagtcacattgtacgaggagtctcttcagatcgatctttgatttctactctatcccttcatctataatatttttgacttctataaggtcctccttactcagatcaccctgaactctacttgcatggtcgttatttttatcattctttgtaactagctcggtatcatcttgaggtattccctcttcatagcattgttcattttgaagaagcaccctcatgagaagggatggtgataactttttcctctgttagagtgcaagttcatcactagtctcccttccttggtcaactgttggaaaagccatttcttcttcatgtcttcggattgaccttgggggtttagcttggtctagggcaatcctcacttgtctcctaataaagataaatttttatccttcttgaggatgagaaggactatcaaaatctgcttaatgtcgaggtgctcgagctaaaggagctactaaccgagcagaatctttatgatatctgcattggtccgacattgcctcgggatacgatcacatcttttcttatttggaaaactttcttgattacttgtcagaacttgagttaaccactctctctatgattttatagcaataaggccaacactttcatccatcaagtcggctctgaagaggaagacgggttcctcaagtgaagaattttcattgaagaaatcaagtacttagccgagaattcctacccccgccccgatgttgtccataggaatgtcaagtgccgaccctatggagatcgatgatgagccactggtggttgagccattgaggtccgttgtgccgatgacttcagagtcagctcgaactccatccccactagctagtcaaacttcatcgtctccaatgagaaatgggtgaaagttgttcccacctccccctacctcacagctagccatctcccatgataccgagcatgtcagtgaggtctgaaatgggcccttcctcatctgagagtgaaagatgatttatcactatagcaaggagagtacagaggaatgattccacacttcagaaccaccaactcatctaggagttggtgaagatgactttgctgttggttgattgatcagagaggagggcctatccctttgacgagattattggtgcttcttgtgccaacctcctcagggtgagtatttcatctcttgtgcttgccttcgacttttaatagtaatcactaactttgctttttctatatagttggtgcatgacatcactgtcctgaatgagggtttggttggtttcaactgagcaaaacttttgctagagataaaatttggggcattcgaggcccatgcgaaagctatggaggaagcgaggtaggctgtcgaggaggtgaggtgggccatcaaagaggcaaaaagggcagttgaggaagaggcttcccgagccaggcgcaatctccagagagctttatagaaagtcagggccctgaaaggcctaatggccatcaagtgtggtgccactggggtgcttcatcagaaggtaattgaactcgaggaggccctggagctcgaagaagcagtggtcagagttaccaggatagggtggggcttatcaaggccaaaaccaaagaggagaaggtgaaggtcatcaccgaggccaaattcaagggcatcgaaaaattcatgactttgcagagcttaagaatgaggtcgttgagggcttcatggtggcctatctgtacgatttcaaagcctataagttgcacttgggttgaatggatcccacgttagacttgagccatcttcaccccaaagttagtgatgacgagggtggggcattctcgtcggatgaagatgcctacctcgatcgaggaccaagctcctggccctactattgagaatgccatggggggcacttcaaaggagaccgtcaatcatactatcgagcctatgcctgagaactcgactaactttatttgtgtttttttttctctttttcattgacagcaaacttcttgtaatagattttttctaatgaaatgaatttcctcttgttatcttttgatgcttgtattgagtgactccagttttcaacatcgatcgcttgcctggctagcttagtcatatctttggttaactactcataaggtaggggttgttggcctggtccatggtttgaacctcagtatttggagttggtctagagttatacaattgatagtcgattcgaagtcatttgatggcaacatttttgtcaatcgccatcattgtcttaacctgattccttaagagatgtttgggaagatctcgatgagatctcattcaaagtcgatgagaagttgatccatgataatttttgccaaatctccatcatcatcttaatccgttccctcaagagatgtttggaaagatcctaatgaggtcttatccgaagtcgatgcgaagtcgatccgtggtaatttttgccagatcaccattgccatcttaacccaatccctagggggatgtctaggaagattccaatgagatctcatctgaagtcgatgccatgtcaatccatggtaatgtttgccaaattgccatcatcatcttaacccgatccttagagggatgtccaaaaagatcctaatgaagtcgcagtcgaaactgatgccaagtcgatctgtggtaatttttgtcaagtcaccattattgtcttaacccaatcccaggagagacttttgggaagatcctaacaagatctcatctaaagtccatgcaaagtcgatctatagcaatttttgtcaagtcactatcatcgtcttaatctaattctttgagggatgttcaaaaagatcccaatgaggtcttgtctgaaatcaatgccaagttgtttcatgataatttttgccaagtcatcatcattgtcttaacccaatccctaaagggatgtttcgaaagatcccgattaggtctcattcaaagtcaatgcaaagtcaattagtggcaatttttgctagttgccattgttgtctttacctgatccctaaagggacattcaggaagatcccgatgagatcttattcgaagtcaatgcgaagtcaattcaaagtcaatcagtggcaatttttgtcagtcgtcattgtcgtcttaacctgatccttagagagatatttggtaagatcttgatgaggtcatgtccgaagtcgatacaaaattgatccatcataatttttgtcaagtcgccatcgttgccttaacccgatccctagggggatatctaggaagatcccaatgaggtatcacccaaagtcaatgccaaattgatccatggtaatttttatcaaatcaccatcctcatcttaatccgatctctagagagatgtttgggaagatcctgatgggatctcgtcgtggaggtcccaacttgggtcaaaatatcttcttatgatcggaatcttaccgatcaccattataaaggtcttagttgtagccaaaatatcttcatgaggtcgacacttttcgacctagttgctgggtccaaatcgaggtctaaatatctcgcatcgaatttcctcccatcatcatctattaaggattgatgctagacttggtgttggggtttggcatctcgaattcgacccacagcagaagagaaatccaaatgcagagaaatccaaacatgaggagcccgaaaatacagtctgaaggcctaggcatgcagcctgcagcatgcacggcccagcggggcctgctgtgcgatgggccagtgcacaggtgtgcggatgcatatggacgcacatggcccagcatgggcataggcatgcggacgtgcagcccaagccgtccatgtgacacgatccatggtggactactggaggaagtcacggtccacatgtgttctatggactgccatggtccaaggggcaaaaatcatagtgcataggaggatttgtgcgatccagcggtcaggaaggcatgcgatcgtgatcgaacgatgatcaagcatgatcgaaagttgtattatgtaatcggatggccaaaagcgcttgtggcaaagatcgaatggtcagaaagattgatgagtccttttgaatgcaggaattcaatctagattgattttagaccctataaaagagtttggagaggctgtggagcagaggtgaagcagcttgatgtcagtagctgcttctatggggcattaggagcagcttgtgtgtagttgcaaaagtagtcgagagtgtcctagaacgatcatgggagtgaccgtcagtataggaatagaggctgagatatgatgtagcagctgagagcatcacaggaagcatctagaggtgtcaaggattctggctcgataggcctgtgagagggtctccttgtgggattttatatgagcttttatgagtgttgtgcatgttattgagagagaagttggtatgtgagagttgagagtgagtgatcttctcttgtatttgttattttttcttatagtgaagcttgcatgcctcgtagaggcaaaccttatgctgatccatatatttaattatattttttattttatctcttctttctttctactgcaacaagtggtaccagatctccaataattggtatcagagccatatggtactaaagagccaagtgataccagagcgtcagcttgttcgaactgtggtggtattgatcaagattgaagaagatggagaagtcaggtataatcatggtggagatcaaccataaagggttgatcgatactctcttgtgtaaagagaagccgtctaccaaagaagatgtcagtgggagcccagtatgaggtggagctccacgaggaggtagattaggcacgagattagagatctaagagaatgataagtgacatcaccatgaggctatcctaagcagatcttaggttagagcatatgacagagatggaatcgagcagtctagctcgaccccatgtttgtccatctatgaatagctggcgtatgactcaggatgtgggggcaagaagatccaaaagctctcaaaatcagatggagacagaatgtcgagtcgagatagagatagttgagatttggtaccttgaattcgatctacaacagaagagaagcccagatttggagaaattcatatgcgaggagcctaaaaatgcagttcgaaggtaggcctgtaggcttggcctatggcctaggtgcgtagtgtgtgacgtgagtggcccagcggggcctgctgcacttaggcatgtggatgtgtgtggcctaggcatgggcgcacagatgcgcatggtcttgtgtgggcctatggcctaggccgttcatgtgacgtggttcgtggtggaccgttggaggaagtcacgatccacacatgttctatggaccatcatggtccaagaggcaaaaatcatggtgcataggaggatttgcatgatctagcgaccaagaaggcatgcggtcataatcgaatggcgatcgagtgtgatcgggggctgtattgcatgatcgatggccagaagcgcttgcggaaaagatcgaactgccagaaaggttgatgagtccttttgaaagcaagaattcgatctagattggtttggaccctataaaagagttcaaagaggttgtggagcagaggtgaagtagcttggcatcagcagctactttcaggaggtatcaggagtagcttggcatatgcagctgtagaagcagccgagagtatcctggaatagccgtgggagtgatcatgagtgtaaggacgaggctgagacatgatgtagtggctgagagcatcacagaaagcatctaggagcattgaggatcctaactcagtagacctgtaagagtctctttggaggattttgtgagagtttttgtgagagttgtgcttcttgttgagagagagattggtatatgagagttgaaagtgagtgctctccttttgtacttgttattttctctcatagtaaagcttagatatcccatgaaggtaagctttaggttcatccacgtatttgattgtgtacttattattttttccatagtgaagcttgcatatcttatggaggtaagccttgggctgatctatgtatttgattgtatcctttatttcatctcttctttttttctgttgcaacaaatggtaccagatctccaatacttggctgctagggtatgcttcttgtgatatttttgatcattcctagtagtcaatgtcaatcgaatgtcttatgtatttgctttaatagaaaacttgcagcatgatctaaaaaaaaatatttattagtataaccaaaaggtgccaaactcatcagtggtacattttcattgaaagggataatggagtttcccacttatcatctctttaccctcttgatagatcttctgccattcgaccgcctatgaatctggagatcacattgatgacatcagctatggatcggttgttgctgtcgttcttcttatcggactgatgctgagatggctcttcggacgcttaggtctatcgcctctgaagatactttctgaggtagcttttctagattagagcttcgatctcatccttgagctagaggcatttctcgatgtcgtaattaggctcctagtggaagcaacaatatttctccttactccttgttggtgggccttcattggttagggtcgatgaagatatccctggccctcgatttctatcaagatgtgggctcgggggccaaataggagagtatagttgttgaagtatcgagggggactcctcaacctaaggctctttgatggttgggagggcccttctcccacctagcccatgcaaggctcttcctgacttcgcttcttattgggggtcttcctttattcagcctacttccctgtggcccgagcctcttttgtctatgcatattttcaagcacatataagtaggttggtgtagtccctcgagaatattttattgagggagaagatgaggtgctcattccataatcctcacttgagcaccgacatcaccttcgagtcatcaatattgtgcaagcatagtagcattgaaacataccatatagtcacacaacaactcatcctcttcctaccagatggagaagaagatattgatattttttgaggtggtgggttcggagattggggctgctttgccacttgctggagttgctgcaccatgcaagccaacatttggatctgttggaccaaggtctctaggggttgtagatcgatcgtggtgagggggttgcacgatggcggactttcaagtggtaccgctttggctacgatgagaggatcatcgacaaaaggcattggagttatatgctcttattctagccattctcttcttcctcattaattgagttaatcacccttcctctggtatccatctattgctgcaagattccaattcgacattgatgtggctgaggatggatatcatttggggaccgagatgccaaagaagaaacctataagagaagtctgctttcattggggtttctccagtaggcaaccctccaatacttgtcagctggagtttgagaatagtagaggaaagagattgtgaaagggagaaggtgtgagagcacatggggcattctctgaaattaagcttatctaagggtccctttattacctctttatataaaggtgaaaatttatgttgtcatgctggaacttagtaggctatttgatcctaattttctaggctgctaggtctcaatctgatatactattaggactggagatctgcccactaacctatatactagagttgttagttatggtgtcagttatggatcatgtccacattttgttaagagattccaaggatctcccatatggttgaatagtttgatgtccccagattggtgccgagtcaaggttctgccctaagttagtacccatgtaggttatcgggctatgttcatcatcatcagtaggatctcgaccttcgggttggtaagtgtccaactaggaggttggatagaaaccgatgacgtaaagctgctttgccttggtttctcaggtccttcgatatccaatgttggtctgtcggtgagagctcagctgtaatccgaggaggagatgtcggattgggttgataacccccacaacagctagtgctaaagttaaattgacctacctgcacctagctgcaagaatcattacattgtgctcttgcatgataaaaccaaatgcctcttggaatcaagtccctattgaaaaccaccatcaaaattgaccttaaagtttccaatagtaagggactgctggtagatcaattgaaagtttagtgaaataggacttggacaataaaggcctttacggtgtgttagaacctacacttttcgattatccatttgagaaattaagtaggaattctgtgtttggttggggggagttggggtctgaaatggaaatgacaatggataactctcattctaaccatttggttggaaggggtctgatcttgattctaattctgaagtggaatgaaaatgatcgaatccccctaaaacccaatcctcactccttcaagaattcaaatttttattttgatttctatttcgatttcgattttggtcatgaatcaaatgctttgagagatataactattctgattcttattccaatctatttcaatttcgattctagtttcaatttcgattgtaaattaaacaccctctcagaagatactcgagtgtttggttcacaatcagaatcagaattgaaatggattaaaatgacaattggaatggccatatcctccgaagcatctgatttatgatcagaattagagtcagaattgagatttgaacatctttagaggagagttgggattgggttttaggaggattgggcttttcttgttccaccctgaaatcaaaatcaaaatggaactctctagccaatcgtaggagttcccccaaccaaatgccctctcactgcttttgtcactaaagtcttaggttagcatatgttaacttgttttggaagagactcccatcctagtgactccatgacagccattcgatgatgcagaggaaatgtttaattgaatgtaagtgttattaccgttcaataaatttagaagatgaacaattatttttttagcaaaggcatgatatttatgccgagaactactgggcaacatggatggccaagcgtttacatgcctataaacaaatcaagatgcattgaaattgcattttcttatatgacacatgtgatgcatatgatctgagtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagaactactttgatcgataaagaaagatttatcgtgtagtccttaaattggtttatgaccaaacgatatgctattactaggatgatagtgatatcaagtataggtcgttgtgtgccatatacgttggttgtcctcgtaaccaaatggtgtggagatactggtatggcatgcgggtgagatatagaagtacatcatcactgaacgtgaccaactacggagcaatctactatcaaggatagctcgtgaagggtatggacataagtatccctccgatcttagatcatcacggtgacttgcatgcaactcactgtactttgatgccagactaactgagtttctaattcagtgacgaaagatttttagttacaatcaagtacttatgaagttggtgtataagtcaagatgggattgatcccttcgaattagtaggagttaatatatcaatgtatttcaatttagtaaaatctggacccaaataatccatgtgatggatttaaaaaaaattgaaatacaatgtggatgacttatctaagattgacaattaaattcttggtcattcttgagtattagagtcaaagggatgaattatacgataaccatatgccaataggttgttgaatgttgcttcatcttcattcgatctatccggatgttgggtcaccattgctagatgattacatcgattgatttaaaaaattatttttatgttatcaatttaagttcgaacctatgaagtcatacttaaaaaaatttatgattgatcatgcggctgatcaacgattgagaatcgttcaagggcttaatcatcaattcgattaatggttaaccttatgcaaaaattataataaattaattcatcaagtattagtaaattaataaaagattaattaataattaaattattgattagcttagtttgattgagcaaagaggatcaaataaaatctaattgagttggattcaattaggtttgacccgattaggttatgagatgatctaatcgctaaaggagaattatccctgatttatcaggattttgattcaatcaatttctaatttgattaaaaatttatgaatctaattaaattgagtttcatatattttatttgggctaaaacagacatgatttggtttggattcaaataaggaaattaagagtccttattggaatagaactcttcttccatgtgcctcccactttgatgccatatatcctcacgcacaaatagtttttgtataaaatttttttatgtcaaagagtgctttcccttctctatctcacatctaaatttgaataggattagattttaaatggtgtgttcaaatctgatttaaaataggataccatatagataatgtttgacattatctctaagaccttatcaccaacttatttttttctcttcatatgtgctacattttaaggatattttttatgaaaaattatttggagaactattttactataaaaaaatatgggaaggggtgttccatattttttttggcatattttgatgtgaatttttgagtagggatgacaacacatcaagagtccatgatctctaggactcttcaccccacctccttacatgttgaaataaaaggagttttattttattcttatgtgtggaagagatctgagagagaggccttcatgtttagaggagtcttgggcatggtttcatgatgtgaaagaagaggagagtcttcttctcttgggtgtgcataaaaattaggtttctaggattttggtccttagggtttgagaagaaaaaaaaataagaaaaaaattatttttctctccacttcttttacctcttcatctcctccagaagtacatctttaatctctaaaaaagttttagagatttgaagaaatgatccaaatcagttaagaagaagatcttcatgtgagctagcactttcgagaagatcgattagatcgaggcttcaagtagatttttcatagaggccggacgtgtgtacgactgcgagcaaccagcaagaatcttttctaccatatctctcagtagcagagatcatcgatccacgctcaggtatcgagttctgaactcagattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctggacgtcgcgaagaatccggtcgacgctggcagggtcctacctatcagcaaaacttgggaatgtggcggaggctcggccgcccgggaggtttgaagagatgttgtcggaggtcgaaagtcagttggatccccggagggtcactcccgtcacgaacttcggctggggggtattttatacccaacagtagttatcttttgaattgcaataatattattatcgatgatttcttaattaaaataatatctgacatcaatgtgcttggtccgctcatgatatattaaatttttgaccaagtggacggcactttagctatcacaatgtacaattatccactattgctatagctaaaactatcaacgaaacgatataattttgtaactttctttacttcctcaattacagttatatgctgtgcttcggttgtaaacaaagcaactttatcttgaagtgtagttttctaactaacagcacaatcaaagagtaaaaattttctatcaatgattgttactaatccaaatcatctacacaatcaaaatcaacatagtttgtactattagatgatctgctactataaaagattagggcaaggtctgtaaagcttctcgaatatctcaatctattttaagaccagtaaaattgctcaaacactgatatactagctaatttacactaatagcatatgaaatattggatctagtacacattatagaatatattaagctaccaactataccggtatgtagaacacatgatatgtgctgtacctcctccatcatttgcaatgataatgaagctaataatctaaagtatgcagctaaaagtgtactcaatagtttggatctcatgtagaagtgttcaagcatcttttctatatatttttttgagataaatacaatcgacctgtgcttatctctataaatttatgtctctaaaatcttcttttccacatccaaatttttcattttaaattcatcattcaatataattaaagtttcaacctattaattttagatttatccttagctgcgattaacatattatccccaaaatcctctgcatgcttcgagatctccactatataaaatggtccaattttggctctctagggcttacaaattcacaacatacttgacacatatgaacatggccatttaccaaatgtcatacaaatggatgtgtgaaaaatgtagtagtatcacactatatattgtttaacagaatataataatgtgtaggtaaatgtcaactaggatgtggacctatgacggaggtggaataaatatcataagtgaaaattggctctatgtcaagaatgtaaggtacgatataattttcttagtttggtcattgatccaggcgatctaaaaatgatgctggaccagatatcctatagaaattttgaagagataatgggcaccggcaaagggcaatatgtcaagagatttatcaggatcattaggtgttatgtagatcagttatggtaagatcatcagctacatttgtagtaaacttacagtatcagttagtactcttaagctttgcagattatgtggaactagttggttgattagaccatcgaggatgttgatggacgttaaaatggacattagaatgggctttataggattgcgaatcagtcaagccaagaggtagtttagataaatgaggaggtcgccttgtccgcaactttgatggccaagagatagcctagataaatggagtagtatacccaacattagattgggataatagaaaaggattcctgcttctagggggtcttgtggttgttagatgccacctggactttgtgaatagaaatggcagactatagcaaggtctaggaatataacacacatttagaatagatgaattaatggtcaaggtgtatggcaattaacacatgggatcatggagttaagcatgagtatcttgtaggcagtcaccaaagtcatgctgctttagggattgaagtgatcaccaaagagttcatggtgaggaagaggagcttgaagtggtataaggtgaagccagatgtggaggagtctagttggctattgccatagaagagaaaacgaagtccaaattgatcttttaaagagagtgcaccatagcaaccaccaatctaatatgaggatctatacaggtatatatttagttctatatcggttattcgctggaaagatcttaagtacttatacatgatcaaagaatccaaataataccttccagctagctttgttggatgagattttagattattataaatggtatcagagttgattcaatacatagcctatgtagttgatactgcagcacaagtttattgagcctgatcacatgctaattatagtatttttgaatggatgcatggattgaaatccttagtctagtaagaacattaagatttacattaagggagtatgtgaggatctatgcggatgtatatttaatctcacattaattattcaccgaaagatcttgaatacttatataggatcaaggaatccaaataataccttccgactattctttttggatgaggtcctaaattattatacttagctaattaggtatgcaactccatccaatctttgtagcatatgcagggtggatgtctggccagaacaccacctcccaagatattttcgatactacgcaatgcagcaggaagaaagaagaaataaacagaaaacaatcaaatacgtggatcagccaaaaaagagctcgcctccatggggcatgcaaacttcactatgaaaaaataaatattacaagaggagatctcatcctcaaccctcgtacacctaatttcttcctcatagaaagttctctctcacaaaagctctctctctaggaagacccctctgaacccctgaagtaaccactgttcgctgtctaggagcctcctgcttcttcttctctcagcgacgcattgcttctctatttgggggttcactatttcctggtttccatgcgaagacgtccacgcccatgaaaccaccagtcgaaccacaccttctgttgagcatcaggcccttttaaagggcttaaacatccattagaaagggattaggactcctaatcaacctcaaatcaagttccaaaccgttggatcaagatcaggatcaacccacaccattggatcgcactccgatctatgaaatagtgccgtggaccgtaagaaatagatgagaaacggctctgcggtccacgtgctcctctgtgtaccgctcggtccatgatggatcgggcaaactggctcgctgcacgatgcttgggcttgggtcggcctgcgccatgcgcatgggggtcggaccgcacgccccacgcacttgggcctgccgggcccgccggctgggccgcgccctgcgcgcacccagcccgtgcgttggccgcgcttgggccatgcactgctacatgcggccgcactgccgttgctccaccggcccgccaccggccgccgatggtcctccaccacctcagattccatgcagacttcaaacgtatgtatctcctccgtccgagctctgtttgagatgatcttggtctcgttggacttcatttttcatcgcagacttcactgtgagctcaatgtggattgaattttgaggcatcaaatcctaacaatctctacctcgactcaatattcggtctcctcctaacttcgagagcttctaaatctcctcacctccatgccctagggcaatcaactgctgatcatagattgataaatataggagtcgagccaggccactcgatcccatctctgtcgtatgctgtgcttctcctaacttaagacatgctcggggtatcatcctacagcaatagaaatcttaccttacgacgtcacttcttgttctcctgagtctcctgtctcatgtttgatccacctccacctagaactccacctcgctctaggctcctcctggctcttgaagctccacctcgcactaggctctccgctaggtaataatatcctctcctctccttcttctccttcagaacaatcctatcgccatgtagcacctttaagattcctccaccagctaccatcctatagcctcttgaattcagtctgcttaatgagataagatttcatctaaaatcagatatgtatcgaacctcccccaatcttcttactgcaccatcatgtgtcctctagctgaccatcccgatgtctctgatagcgcagctcgatctatccgacagataaatagtatcttcactgttctctaaggagtcaaactgctcctctctgtaacatatataatgggtgcatgcagaatctaatatccactgttgggaagaagtagatacctcgtcagatggctccaagatatctccctctgaattgttactggccgtcgccacagcagtcatcgtctgatttttgaattgagagcaatctctagctagatgtcccaactcgtcacactggtaacacctgatcttgctcaagtctctcatggacttggaccgctctcgtcgcgatctcctatcacaccatctactgcctcctgctcctccaaaagccaccaaggctaagctaccgccacctgagcttgaagccgagttctccctcctgagaatttcgttctagagtatcaccgtggtgacctcatctatcttgatggtgctcttctccactagaagagcagtcaccaaggactcgtacgatggtgaaagcgatgccagcaaaatcagcaccctgatcttctcctcaacattctcatcaatgctaaagaggtcggtgaggatcttctagaagtggcttagatgctcctgcacgctctgtccctcagtcatttgcagctggtagaactgcctctagaggaaaagagtattggtgagagacttcgctatatacaactcctcgagcttcaaccacagcaccattggagaagtctcactaagcacatagatcaccacctcatccgtcaggaacatgtggatggtactcactgcctgcatctgtagccatctccaatcctacacctccatggtggtcagcttctcgtcgcacaagaaagcatcaatcaacccttgttggatgagcacgtccttcacccttacttgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaccgccgttccaccggcccgccgccgacggtcttctagcatctcgagtttcgtgcagatttcaaaacgcgtatcttctctgtccgaactccgtttgaggtgatcttgatctcattagactctgtttttaatcacggacctcgctgtagaattaatatagatcaaatctcaagacgtcaaatcttaacgacatatgcttttatacccatccaatctttgtggcaagctccaacctacgtgttttcatcgagaacttgcactacgagtgtaataacccggctcttaaacccctggactggctgaaaatggttggccctactttaatctgaaaacacgtgcttggcacgttggagaaggggaggtagaggactccgaccgcgagtcttcttctcctccaatttttcattgaaagccaagaataatcccaccaaaacttagattaaaacgaccccaacttttgtctataagtactcctctctcttccttagatttccaccatcaaatttcttgggacatcgctaccgattctgcgttgtttcaagcccattttcttgggatttcgtcggagagatcgtcggatctctcactattggatgtcgccgaattaagacaacattctttcccttcttctcctcctttttctaacatcatcgtcaccagatctgatcgatgagccaccaagtgtattgtgaatagggtcttccctgttcccttgattccttcttttgttttcccgaccaccggtggttatgaccgctgctggggttgcgtctcagttggcatcgggcgctgccattggctgtcggcctaggtccccatggccatgaccgaacaaagagagaggagcagggggtgttcgtgccctgtttttaaagaagaagaagagacggagaacgttgttctcttctctctcttccttttatttaactcctccctttctctctcattaattaggttgagaaaaacctttaaaaaaataaaataaaataaaaagagaaagaagaaaaaaaaaaaaaaaattaactctctctactttctctctttaaaattttttttcactagattattttctctaggagtctcgtagactagtggagggtccaagtacttatataaatttaaattttagttgaccgtaggaagagtcctggatttataatattaggatcattcatcataattttttactatctttaatcatctatgatttttatatttgactctgatcatatagagatgtgactgtttatacaaggtgtcaagtggaagattttatttcgagttcatagatcgaggagttcatcgatttctgtatatgggacaatcaccgataaagataaagattcttggacatgaacatcgatgtatatatatatttgtactgcatgatttggtttcttatgactaatatttattttatatttgtcggtatgattatctatatattctgtatcatatgtttatactgcatgatttggtttctcatgactagtatttattttatatttatcggtatgattatctatatattctgtatcatatgtttatatcaaacaacaattatttttcggatggtttgggatgtgataccggttattgaaaaaataatataatatagtatttttttgacataaattaagacttaataaatggatgatcaagagaggatatttgaactagccatgttaaactgagaatagcctgtcatgggcaaagatatggcactaagaataatctaccatgggcagatacatgctatcgagaatagcctgtcatgagtagatatatggtaccgagaatagccccatcatagacagatgcgtggtatttgaatttttcactttaagctgaagcacagttattctagtttgccatcgtgggtggaagtgcggttattctagtttgccactgtgaacgggatcatggatataaaaatttaccattggttattagggtttgtcagttataggctgaagcatgatcgtgattagtccaaaattctaaagataattatagattaatccagattaagttaatgagatatgggtgataagatataaaccatgattaagtaaaaagaagttttacttgattacataagtatgatatatgacttttagaaaagatggatttttgatgataaatgatgcatatttttatattgagctatattggatacttgacatgagattttgtgacttatatttctttgatactatttatatgttatattagaattattattatactggtgtgagtgtgtggggatttttactggactgtaaagctcaccaccccttttccttttttttttttagtagttacaggatacatgcagttggctataattgggatttcgatttgaaaaaatagattagataaaacatcatcagtatcagttggaggatcgagttttgtaaactgtacaaggttgatatttgttaatatgaaattggatattttgaattgaggtcgataatgattataggatattgagattgtaagaaattttatagattttgcatgttctttaggatttatcctaaggagtgtacagccatcatgtatcctatccgaatgctgaattcgagatgttacaatgagtcctaccaaataatgtgctcaacaatgattggtggtggcattcagtctcaaaaatcatcatggatgaatacaaatagatgcggtatccaaatcttgcctatcaactgttggatcatcctctgcatagctttcaaagcacttcatttgcacaagtttgaaagagaaattgggatgacccaatggttgacatatgcgaaggaagatgaatcctttcacccaaaggacacaaccatgctccaccctaccaatcctcctccatagagaattcttgattcgatttactctaccacgtgtgttgaagacaaagccaatgaaaaacataacatcgcagcatacatcaatgtgttgaatggttaaggaatgataagagaaattgttagttagaattgttctaccatgtatatcttagactatccaataaattaagtcaacatatcatcatccattattggaaaaaaggttcactggtaccaagcttggttaaaaattttgaatgaaaagaggtttaaccatggacagcagttcgcacattttactattttgaataaagaaaagttcacttttttttagatgatgtgttgattttttattgaataatctaaggtacacatgacagagaacaatactaaccaataatttcttagtgtgttgagatgattacaaaattcttaaattcaaaatactaatgtagcatctttttattgagtttgtttacaacacatgtggttgactaagtctatccaagaatttttcctcctccatgcagtccctacactcgctaattagataccctcatgtgcggcaaccccagcatccatcaatgctaccgatgacgctgaggccgctgctaagtttgcattgtaggtaggtaagagagattctttgtgcaccacgggtgtagaaaatccgatgtggagcacattgttttatatgattggtctacatagccaccacttctcaatgcatatttataatatcctatggcatattatgactgcttatacgccggatgtcataatatggcccaaaaaattatgacatcctatgacatattatgatatcatatgtcaaattatgacttcttgcatgcaagatgtcataatatagaccaagatgttataatatagaagaggtatttttgtccaatcacttttcaatacacatttaatacatgcagtttcactattttgtttgaaaattttgaacgacgaaaatacccttgctctttgaaaaaaattatgatatcctgcgtcaaaattatgacttcctgcacgcaggatatcataatatggacataagatgtcataatttttttaaaaaagcagagatattttcgtcattcaaaattttcaaatgaaaaagcgaaactataagcattaaatgtacgttagaaagcggtgactacgtggaccaatcagataaagcggtatgttttatgtcgaattttttataccatctgcggtgcacaaaaaattagccttataggtaaaaaggtcatgaatgatgggctgggatttggcggtgccacatttggcgcatcaattaccaattctggccacgcccagcccgcgccagcacttgacccagtccatcgtaaggccacttcaatctgttgcttgttcccaagcggttggtttaggtgaacgctcatcaaatcttcgaaatacaagcgctaaccagtcaacctttcagcactatctgtcgtaccccgatggcatgtacctggatcgccgatgctagattgcattacgggaaaagaccctgcccatagaatgttgttcctccatgtcgccttctgatgaccttttatttgctggtttacatgctaatggaatatccttagatgccgaatcaggagtggaaattaattttacaaagcaatacctagcaagatgtctaaccaaaacggttcatggctagaccggcttccctcctcgatcgtcaataaagtcgatcaaaacccgagggtctgcaagtttggcatctttttttgggttttaatttgtttctctacagaccattgaagcaccaaaaaggggttgatgttgaagattgaatttagaggaaaacttctgctattcattgctttcactttcatcttgaaatcaataaattttcgcttccaaaagctttaaagattgtacaaacagcttcaagatagaaataagaaggtttcttcacacatactgtacgttcagtgccctttggttcatttttcttcttgaattatctagaaaaaacagaaaactgaggcatgcatgcaatacctagctaccaagatattattaatttatggactggctgagatacgcggtgccatcccataaatccaccaggctgcattcagtcatcagtttcgtttcttctaattaattgtttcaaggtgagtaaactagaatctggttattcccaccagtctgcctctcgacgcacacctcatcatgaagtgcacgtaggcgtctccaaagttggtgaagcggcgactcaccagacgtcccagccgagccttggcaccacccctcttcccactcttcgccggtacctcgctgctcctccgtgcctcatcatcgttgacttgcacctcgggctcttcctcgaagatggtcgccaacccgctcttcagtatctcctcgatgttctttcgtgactcagttcgaaggcccttctcaccggtgcaggagatcacccataagaacttagaccccctttgcttcatttccccagtccaccactacttttccttaggaacttggcggcaggagggctcaaggagtttgtgagatgttctgtgagactagctggctattttgtgtctatatatatacatgtgtgtgtgattgtttaggtagtacaaagggaatgaattataattaacgatcggtacgcgtgttaaaaacagctggctcatttgatcaagactttggcggggtcagaaggctatatatattacagaggaggagcaggaggacttgctctgcagatggagtcgtgatgatgtcatcttattcttgtcacgttgggtttaattaattaaccctcagaccatcacattccatggcataccattttttttcttttttcctcaacaaggcaaggttccagcgcgacgcggttgatttgtatctggttttatgctgcctgtgtttttggatatagtactgcagctggatcttcattacctttttctttataaaaaagtaaggggagattgtaatcagctgttccatgatctctgtgcggcaaaaattgtttgtcatcttaacaagaaagacctggtaagagttgaccgtgtcagatgcaaagaaataatgaatgcgagatgtgttcttcgtaggatcgggttttgttcacgtacgccacgtctaaaatctaaataccacgtcaaaggcttcggttacgatcacagtatccttccctgcacgagttaaacgctttcaaagcctgttggaggaggctttacgtcgtcgcagatgcagctcaagcccgataggcgagtaaactcattgcagcggctgggagataaagccacctcaggttatccgaaatacaaatcaaaaagttggaagcagcgagccctcgtacgattgaccacgaagcgtgtctttggtctgtcggacgttgcgtcctgacgcggttcgcatatgacatgattcattggcttccaagctgcacttgtaatcccaaaccctttggagtctctctctggttttgcattaacaaaacatacctttgcagataagttattgtaactcttcaaccttgctttttatctttctttgtgctcttggatgctgttataagcagaaaattcttttcatagataaagctgatgcgcaaaagagctgaactcccggctcatagaagcaaccgacctaagggtcggctatcgattcgaacgctgactgtcaaccagcacatcgactacagacctttgtcctctctgaccccgacgctgatgccaatctcaattttggccattatctcaatcgtcattctaaaataatgggctgaggatgccagcacacctatcaaatcaaaccattaagagagagtatttgcttacgcatggagataggccacatccacctcctggctcttggcaaaactaatatgagccattaagtggttagctactcaaaatcaggagaactagctaggtgaggatttaaaaagatatatccaccggagacaaaaggatgctcaccgcgctcttcgtatgtttctgatctttgtatgtaagtagaggcaaacaaggaacctcaaaggtatgaataactctaaatgctcactctctcccatttgttctcgatttttaacttgagcattggagagtctccactggagtcatctccagctagggactttatttgcagatcctactatcatcgttctcgccgaacctcgatctactccggccattttaacccaagccaggaatcagtgacaacatattggcactagaggaagggtccctaatcgattgagtttttcttgattggagggctactattgtaaggatttagtcccacatcggttgtgagtcaaggacaactctgccttatatggtctggggccttccacccacgtgaggtgccttttgggtcatctcattagggcaaaactatgcggagattataaaaaaatggctccagagcggacaatatctcacagtagaagctgagggggatgggggtaggaattacccagtcaattgagtttggagttccttgtccacaacatatgctagtggtgaaaagaatttgtattgagtttggagtcccttgtccacaacataagctagtggcgaaaagaatttgttgttgctttacaaggcatgccttgtccacaatatatgctagtggcggaaagaatttgttgttgctttacaaggcatgcgacgatcatgactagaatattttgtaattacgaaagttagaagtttcaaactatgatcaatatacgattatatacaatatgctatcagaaaaacatagtatgaattaagtccttggttccaagctccgaagattttaccgactacactctagtcggcacctatttaatcaagacaacagtagttgccaaaaaaatatcaaatactatatagacatcattaaaagggggaaaaattggagtaatcggtgtgcggcacttgcctataaaacatgatacgtttgggccattggtcataataactacacatgcatgtatgcgcaggtttctatctctgctagcatatgtgtcttggatgagaaacttcaacttgtttctcaatatgggtgtcggatacattgtttctcgatatgagcccgccacttctcatgtcccaccatgacttcggctgctgcacgggctgtttctatggttgctgatcatcggccccatgtgagtcatgttagagtggagggtgactcccttactgtcatccgttggatcgaccagtaccctcagccactgcaccaacgatctacgccacctttacttcgtatgatatcgttgctctgagatgccattttatttggttttgtgttagccatgtgcatcgccgagcctatctgtctgctgagtggttggcctcttttggtgcatcccatgtgagagccctctttcggactacccagctacgcctgagcgctgaccttgtacgcacggaccaagctgggtgtgtgtgtttcggcttggagtctaacttcctctagtaatcaagaaatatcaaatttattaatctgaatacaagttttagtcttctgcaagaaattttttatacaaccttttatttttgagaaccaagatggaaggattcttggtcaaaactgtagtgaggagcgagactgagtccaagtcaccgatatccaaatgcaatgactttattaaactcaacgagttgattttttttcttaaataaatatgttctatgatttgttccataaaagttatttctaaaattcatcaatttttctaatatgatttttcttagaaaatcctattagaacaaattagttgtcaaatttggtcagaaaagttagtgtggatcggaaactatttctctctctctctctctctctctctcaccggtaattctacatcccaaaaactcatcttcgttgatatgtcataggtttcatgatcttctacattattaaaattttaaacttaaatttagattttttcgtagttgatagcttaattatcttgttggctattctctttccaagagagagaacaaattctttaaggaaaaatttataaccatgtcttcatatttctcaatattaatgaacgttggtgatttcatgcatgtattttaaaattttttaaataaattataataaaaggtaattagattaatcaaattaatctaacatacatatgatttaattattaaatcaacctactctaggatctatgacatgatatattgcatataaaatctgaaaaaaattaaatataaaatcagcatgcatgcatgcatgtgagcagtagatcacatctacttttaatctgagttcagaactcgatatctgagcatggatcgatgatcactattactgagagatataataaaggagatccttgctagttgctcgcagccgcacatgtgttcgacctctacgaaaaatccactcgaagcttcgatctgatcgatcttcttggaagtgctagctcgcgcgaagatcttttttttgactgatctggatcttttcttcaaatctctgaaactttttcaaatgttgaagatgcacttctagaggagatgaagaggtgaaaaaaaatggagagaaaaatattttttttctcttcccaaattctgaggaccaaaatcttaaaaacctagtttttgcgcacaccccaagaaaagaagactctcctcttttttcacaccatgaaaccatacccaagactcctctcaatgtgaagacctctctctcaaatttctttcatatataaaaataaaataaaactctttttattttaatatgtaaggaggtagggtgaagagtcctagagatcatggactcttgatgtgttgtcgcccctactcaaaaattcacggctaaacataccaaaaaaaatatgggatgcctctttccatatttttcattgcaaatcgattctccaactgattttttatgaaaaatcttctcaaaatgttgcacatataaggagaaaaaaataagttggcgacaaggtcttagagataatgtcaaacattatctatatgatatcctatttcaaatcagatttgaacatactatttaaaacctgctcgtatctaaatttggatgtgagatagagaaggaaaaggatggcatgaaaaaattttatacaaaaactatttgtgcgtgaggatatatggcgtcaaagtgggaggcacatgggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctgatcaaatcagggataattctctcttagcgattaggtcatctcataacctaatcggatcaaatttaattgaatctaatttaattatattttatttaattttttttgctcaattaaattgagctaatcaataatccaactactaattaattcttcattaattcactaacacttagtaaattaatttattgtaacttttgtataaggttaaccatcaatcgaattgacgattaagtccttgaacgattctcaatcattgatcagccgcatgatcagtcagaaacttcttttaaatgtgaccccataggttcgaacctaagctggtagtacagaaataattttttaaatcaatcgatgtaaccatctagcaatggtaacccgacatccgtataggtcgaatgaaggcgaagcaacattcaagaacctattggcgtatggttccatataattcatttctttgatcctaatacttgaggacaatcaaaaatttaactgtcaatcttagatatgtcatccacattatattttaatcttttttaaatccatcacatagattattcgggctcagattttgctaaattgaaatacattaatacattgactcctactaatttagaggagtcaatcccatcttggctcatgtactgacttgacaagtacttgactgcacctgaaaatcttccgtcattgaattagaaactcagttagtccggcaccaaagtacagtgagttgcttgcaagtcactatggtgatcttaggttggagggacacttatacccatatccttcccgaactatccttgacagcagaatgctccatagttggtcatgttcaatgatgatgtactcctacatctcatctgcatgtgataccagtgtctccacaccatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttatcaaaatatacgttccaactctgaaatacttagcattgccttaggagaaaatatctcattatggtcaatatcataatgttaacaatattcttagaaaaccagacgagctttgtaggtctccaccttctcatctgcgctctctgatcctattgaagatccacttacaccctatgaattttacctcttcgagtggatcaatgagtgtccatatatcattgaccttcatggactctatttcagactctatggctccaaaccactaatcagagtcgaacctctgtatggtatccatgtaggcgatcagatctttgttgttctcatcgagttcaacaggatcacattccaaaactaaaaactgaagtatctatccgacggatgcgatactctatcggatctctttaatggtgcctctacaatggatttcagatttgatctagtcaaatctggttctataagttcaccagattgtgtcggttcttctacctgtcgaacttcataagtttcacattaaagatatcagtaccttcatcaaggtactctttttctaaaaaaaatgccgaacaactcttattctttagcatggtagaagttatatctcttagattctttggaatatcctataaaataatacatatagaattgagatccaagctaatcgatctgtaaatgctcaacataaactgaacactttcaaaccctaaggtaagaaagtatcaacttatacctagtccatatcttatatggagtcattgtgactgattaattcggaatccagctcagaacataacaagagtcttaagagcataaccctaaaaggagactgacagacttgcaaacctcatcatgtatcaaactatatctaacaaagttgatttcaataagagagaatcttattttcttttagatatgtcaaaaactcatcggaaggacattctcctctttgttctgatcgaagagtttcaatgctctttctaatttatttttctatcttattatggaattatttgaatattttaaataatctaaatttataataaatatgttcgtatatccaatacatcaatatgtatcagactcagaacactattggctcgttcatcttttctagcaaaagatgatttgatcatcttactaaggcgataggattgataggtcaacaatgattgacaatcattgacttcaaaaattatcctgttgattctattcttgcttcatgatcgagcctaaattgccaaaaataggcttctaagatataatctacttaggagtttgattgttgtgtactatacactaacaggctgtgattattcgtaaatatcatttcttagttgtccacatgattttgatatcattcataatgatatcacaaaaatcattagacaatagtgacaatcaccaaaatgatattgatagaattgaaaataagctcaacgattcttaaaatcaggattaaaacatgacttccatcttcaacattcaggaacctcttactattttcaatctttctactaatctgaagtcgttacaataatttgtatagactttcaatatccaataccgagacagtagtgttatagatagagaaatcacaaggtgttattatataagtaccttatccagcaaccctttactgatttttcttccttagcctgttcggatcaaggaactctatcagactagattaaccttagattcttttgtcagttcagactcattagcccaagcacgactcttttgtaccttttttctttttttttctcaaaaaattgttgccccattaaagacacatctttaaaggtgcaaaaaaaactccttcaacatttgaaggatttcctcctactgaatattaacaaatttacaactaaaattatattctttgctgctctcaaaatacaacacatagtgatacgatcatttggccacttctgataagtgcttttgatcgtatcatatgtgttggacatgagaacttcaggtgctggatccataatcatatgtagaatccattcgtgctctagaactatttgcaacttctgataccatatatcaaagttgggtcctataaataagtcactgtcaaatagtgaatggagcaacaaaaatctagccataactgaaagaaaaaaactcaagacctctatgtttatgaattgattaagcctaaagacttggactttaatctaaaggttctctcattattttgatcgaattggtagcctctaccttcaatctgagaaattatcctaattctttagcggatactagaatccacacaaactgcatacaagtctgaggatagttctgtcaactcatatgcatctatgggtagattctcaactaattatttcttcaaacaatttctagtaattaattttatcccagattttatttcagtaggcgatagatctccactaaaagtttcagttagatcaaaccattaacatgtaaagtttcaattccattatatatagtacaattccagtattttttatatatcgataaaaattatcaaaaaataaactatatattctagaattaaaacaaagagaaaattcaaactagtgatctcttatttaaatagcaaactattaatcatcaagctataactgatataattagcatataaatatagtttatttaactattaacaaatattcatatcattaaataaataatgctaagaatatatatatatatatataatgacatattttatgagatcaatatgactaaatcaaactttatataaaaattaataatttaatatttagctataattttttaaaatctcataaattatgatattatttactagcgtattagttaaataccatgatagtagttctgatttctcccacttcaagttatatactgtaaaatataaatttataatgatatttgtaataaagtactataattaaaaaatacttattgaaagataacgttatttttaccaaaatacaacaaaagaaaggaattttagtggcatataataagaaatactccaaataatttatcaccaaaaatcatttttattataatataactaactaataatacgtgtgcatgtgttcctcttttaaatcaaattcattatttttcaatcttctagcagctttttgtgaggtatcaagatccatactatctataattcatatgaggattcttaatcattcataatattgggtgctaaggtgaatctgcccttatattgtcatgttgcccctcgatagatgggctgcgcagcataagaaaaacttctaaaaattctctttgataagattgtctcctaactcatgtaatgctcacaatcggtatcatgaagccactatatttttgcccccttcttataggcaaacgatcatgaattattatcgtctcggatttatcgatttcactagtgatcctctataccttattatgattgataatctcgagtttcagtaaagtataactaaaacatctcttagtagttcagtgtgctgcggcttcattagtgtgactttcatgttaccttggttagtaaattctgagttcttcatggctgaccaaggtcaattaagtttgcagcgtagcacaatctcggcactctagataagaaagagtgtagcagctcgttcgaaggtcacgtgaccaaatcgcaacgaactctcaccctcctctctatataaaccaggatagagaacctaagtcaaaaaaaaattccccatgctcttagctcattgctcttattcttagaaacccattattctaccaagactctgcttaactcaagtagtagagtctctcccactagatatcgttctgacaaccttttgattgcttttttctcttgcaggtcaaatcttattgtgtagcctagctccagctgagccgatcaatttccgctagatcaataactccatcaggtcggattttggatggttgcagatcgacactaaaaaagggcctgagtttatcgaagatctaagatcataaagttcaagaggaacagccactaatccacattcaaccaagtttaactggagtccaatggcttcaagcatagccccgggagatccccagaccctatagatcccaagcccttcaaccaacctctaggttgtcactatcgagcaattcagcttgcttgtacaacatgtataggctctaaccaccatgtgcaaaacctacaacagccgaacaccaacctgtcggtaggccaattgaaccaagctgctaggttggcttgactctgctgtagctatcccatgcatggagagctactactttattacttgctgttgcttcaaataataaacctacaggagattgcaaaagttttcgaggtttaaggcttgaacaaacaatagcaagaatgaaaacattccaacaaaagagctagactcactagagtagcctgcaattactattgagtgagagtaggagtgtggtaatagccgatctctatggttcttcgaatgggctaagaggagaaggattccttgagagtccaatcctacatgctatgctaatttccatggtttttgagtctcaatcgcattacccccctgtgaccccctagaatttgtttagtaacatgtatcctcttgcctaattttgtttcaatttgataagtcaaatttctttcattacaagaaatataacctgctttcagacctgattctaaaatacaacactcatgcaccaagttgttttgatactaagatatggatttgttatggtggaaaagaatttgatgacatggcatgactcgattggtccaactcagggctgatgtactattcgacatggctggaccaaactgacctcagtcaagtgaaggagctgaataagcagatcaaaagagctctgaggtcacatgtcacgcgatgtgaagttccttagctcaggtggatactcttctagctccttgctgaccccaagccaaccttagttcgcttatctcagttagcagtttttctgccatgcacgaaaggcgtttctctccatcaagctggagataaagcttaccataataacctctgatagttacactgaatcttcagatagttatagtgcaatcctaaatggttacaacacaactccaagctattaagatacgattcacaaaatatttgggatcctacagctataaataaaccaggaaatctatataagataggtacaccttaagagcaaattattagttccagcattattactattgttattattaagatctttattctttccatctttctatcttcttcttcctcatctcctacaaaaacctctatggcttaagcatcgaagggctaagttggagctaatttggtgagtcctctaacctcgtttgttgtcttgtagatccatggaagcaacccatatcgttcagggattggcaacactgtctatgggaatggaagaggaaagaccatgaggctcaaaagatgcaaccatctagcatccattcagccaactttggatggtttccaacgtgaccctcggagatctcgacgccctgcatgggctctgggagtcatcaacgttgaacggttcaacttgctcatgcaatatgtgtagaatcaccatagcagtatggaatctgtgaccgtaggccattcactctccggttaaccaaccaaatcaccaaggtcatctagcgcaaagaagtagctaccctcatcctgagagcctgagggcagactagaggcatggttgctccagatcctgctctccctctatgatagcttccaatctcaacaacccttctccgtattagccagaaacaatctccaggcagggaggcaaatctcaactacaagataaaggagaaaccccaagatttactaaaacctctgttgcggccaatcccctcgtcgcctggtcaccgggaacaagtgcctgcaaaagaagtccgcactgaccggaggtgactccggcggggaccctccgacggtcaagtcagagaggagactaggcaacagtagaaaagaatcaaagagctcagcgagggggggagagagagggtaagcccaaaggtttcaaaagaacctcctccagcactgttgcatccccgttttatagtagagcgtggtatggctccgtcattaatggcacagacaatgagagagttgtcaaatcgccggaggctgtcagagtcgccgtggggctgtcaaatcatcgtggggctgtcaaatcactagggttgacccatgttttgggtggaacgatgtcccagggtggctacgccgcatgactttgtcaggacggcggccctcagcagtcgtacgacgtttgggagagctggccgaccatacgtcggtattcgctgtcgggacgtcggatgatggtccggaggtaccgtcgactggtctggtgccttgcttaagtcggacgtcggctgccacctccgacggtgagtcggtaatatggattcgaccgctcagtcggtcgggaacaacataggtcggttcggccgacactcctttggtcggataatgtcggcagctactgtcggtagtcatcgatcggtgcagtcggtagagtcagacgtccgtcagagtcgtccgtcggtcgtcgatcagatcggtccgagagtaagtcggcgtatgggggtcaatcggtatatcccaacagttgcccccccactcctgagtctgatgtcatgttggctcgcgtgaatacgtgggcgacggcttcgggcaaaaggagtggttttccgtcatgtcttgccccgactctagcgatcgcatcaacgaacgatccgatgtcggtcatctcgactgtaggtcgagtgagcacgtcgggtcgaaggtcgaccaacctccgaacgttgctcgtcgatacgatcattccgcaaagtcgagtagcgtctgacatattcagataggataacgatggcaagtcgaatatccatcatccgacctttggtcaggcgtgcacgtcgggacgtatgataaacggtggtaagccgaatatccttcgaccgatcgtgaccaagtcggtatgtcgcaagtcgaatatccgttgacgtagcatgtcgagtcgtatgatagatggtggcaagccgaatatccttcgaccggtcatgaccgggtcggtatgtcgcaagtcgaatacccgttgcccagaccttggtcgggcgggtatgtcgcggttgtcttggcgttttgccctttcttagtcgaagctaagttggcaagttagccagccgcgttggtcgaagctttttgccctcagaggcataggccgtcggttcggtgatcgatgatcgagctgttgattcgacgatcgacgatcgagccatattggtcgaggcccttttgctttcagaggtcgaggccgtctgttcggcgatcggtgatcgaatcgttgattcggcgatcgacgatcgagccatattggtcaatgcccttttgccttcaaaggtcgaggccgtcggttcggcgatcagtgatcgagccgttgattcggtgatcgacgatcgagccgtattggtcgaggcccttttgccttcaaagatcgaggccattggtgatcgagccattgatttggtgatcgacgatcgagctgtattggtcgaggcccttttgccttcagaggccgaggcagtcggttcgacgatcgatgatcgagccattgattcggcgatcgacgatcgagccgtattggtcgaggcccttttgccttcagaggccgaggccgtcggtgatcgagccgttgattcgacgatcgacgatcgatccatattggtcgaggcccttttgccttcagaggctgaggccgtcggttcggcaatcggtgatcgagccattgattcggcgatcgacgatttagccgtattggtcgaggcccttttgccttcagaggccgaggccgtcggttcggcgatcgatgatcaagccattgattcgacgatcgacgatcgagccatattggtcgaggcccttttgccttcagaggccgaggccgtcggttcgacgatcgatgatcgagctgttgattcggcgatcgacgattgagccatattggtcgaggcccttttgccttcagaggccgaggccgtcagttcgacgatcggtgatcgagtcgttgattcggcgatcgacgatcgagccgtattggtcgaggcccttttgccttcagaggccgaggccgttggtgattgagccattgattcgacgatcgacgatcgagccatattggtcgaggcccttttaccttcagaggccgaggccgtcggttcgatgatctgtgatcgagctgttgattcgacgattgacgatcgagccgtattagtcgaggcccttttgccttcagaggccaaggctgtcgtagatactccgctccttcgatctctatcaggatctgcgcacgaggagcggagagaggggtgtaggagtcatacctgcgatgcatcggtctcggactccgtcgtcggggcaaggcccatctatcagtgggggaggcctgctgggtttagtaggggcccgacctttcttccattttttcttccagcccatgccttaagtcagacgtcggttggaagctccttcgtctgcgcgcatgtatttgtacgcgcactccagcaattcggcgtatgtccggaggagggtcttatccaaggagtatgtaaatcgggacctccttagccccctcttcatggctaagatagccatgtcctcgttgaggtctcaaacctcaagcgtggccgtgttgaatcgcgtcacgaagtatcggagcgtcttgttttctccctgtttgaaaaaaaaagactgtcggaggttcatggaggcttccgactggtgctgaaatgggccacgaaagtatgttcgagctgtccgaaggagtggatgcttcctgagcggaggccgaagtaccaggccctggtggccttgtgaagtgtggcggaaaagccgatgcagagaagggcattagtcgccccttggatcgtcatgagagccttgtagctctccagatgatcaactgggtcggtggagccatcgtagggctccacatgaggcatcttaaaccgactagggatcggctcatcgaggatgagtcgggagagaggttgggcggtctgaaagtcgacgtcgttcgaggacttctgtccgtccacctgcagctgggcaagctgatggttgatttcttcgaacctgcattcctagtcatcggcccgtcggtgctaagagaccccgggggtggagtctcccgatgaatctgagagggaggcggacggtgttcgcggtcgcttctccttccttgctcgttccagctgggaaggagatggtcgtcgggatcggtgggcatcatgttgtgtccgccttccccccctcggtggaagtgccgtgacgactgctcctagggaggggatggagaccggcacaggcatcggcggctgctcctggagggcatcgggtgtgccgtcggttgctccgccggtgagtgtggcaactgggttggttgctgttgaaggctcttgaccgcatccgtcagcacggtcatctgccgcacgatcgtcgcgaactgcacctccgtggtcaccacaggatgtggagagctaggttccatcatggagggtggaggagaggcctcttcccgatgggaagagtgcctcgccgatccggtggccctcgatcgctgagccctggttcttatcatttcaaaagggtgtttcaagttctgtgggggtcgtaatccctacgttcctccatggtgcaccaaatctgttgtggccaatctcctcgtcgcctgatcatcggaaacgagtgcctgcaaaagaagtccgcactgatcggaggtgactccggtggggaccttccgatggtcaagtcagagaggagactaggcaacagtagaaaagaatcaaggagctcagcaagggggagagagagagggtaagcccaagggtttcgaaagaacctcttccagcactgttgccttctccgttttatagtagagcgcggcatgacgccgtcattaatggcacagacaatgagagagttgtcaaatcatcggaggctgtcagagtcaccatggggttgtcaaatcactgtggggctgtcagagtcaccgtaggactgtcaaatcactagggttgactcatgtcttgggtgggacgatgtcccagggcggctacgccgcatgcctttgtcaagacagcggccctcaacagtcgtacgatgtttgagagagctgaccgaccatacattggtattcgactgtcgggacatcgagtgatgatccggaggcaccgtcggttggtttggtgccttgcttaagtcggacgtcggctgccacccccgacggtgagtcggtaatatgggttcgaccgctcagtcagtcggaaacaacatgggtcggttcgaccgacactcctttggtcggataatatcgacagctactatcggcagtcgtcgatcggtgcggtcagtagagttggacgtccgtcggagtcgtccgtcggtcgtcgatcagatcggtccgagagtaagtcggcgtatgggggtcagtcggtatatcccaataacctctaagataatagaaaaaggtctcggctaggctgtgctaaggagacaccccaggattgattgagaccttcgaaaaagcctcagcttgactgatcagaggagtcatcctaggattgactgaaacttttaagataaaaagaagtcttcgtatgaccaagctaaggggacactgtaagaaaattttttttaccaaccgttattagcgatgacaattttatcatcctaataatattttttattgataataaatggtgaccaacaaatttattattgcaaaaaaaaatagtgatggtatttttgatttttaatgacagctaattacgtcactaataaaaaataattttatttttttaatttgattcaagaattattagtgacagagttatcttattagcaatggtattttaccgtcactaataaccttaaatttttccctctgatccctctctcccgccccttggttctcacgatttttatctaattgtgtgccccaattttccccacccccctctcattttttcccaccagcattcgactccctcccctcaatttcaccctccccgagcatccaaatcctatttttctccatcgacggccgactgactgctggattccacttccccaagccccgactgcctcctcgagcccccgtccaccgaatccaagcccctcggccacctcccgactcctcgaatcctggccgcctccaatctccctctttcccccaccgtcggatcgaatttcttcgagccttcagctgcctctccgagcccctgtctgtcagatcgaaagttcctcgaccgcctcccagagcctcggccgcctccgatcccccacttcccccgtcgtcagatccggctttcccaagctgtcggccgcctcctcgagccccgaggcatcgacctgcctgtctgagccatcagactacctcctcgagccatcggaccatcgcccccgcctccccccttcgaacacccagccatttccatcaacctcatcggtcgttgcctcaccacgccacctcaccacaccacctcgtcgtgcagcccatgcccatcaaggacgtcggtcgccaccttgctatgcccagcaacctcgccgcctcgtcgtgctcatccatcagctacctaaggcagatcaccaccattcctccactcagtgccatcgacatcccctcctttccatctcgatcgcctcaccgtcgatcaaccatcgtcgatcgcctcaccgctactctcttcttctcggacagccactattactcaccaccgttagccaccatcggctcctttgcctactgcaatagtgctaccaagagccgctgcccttcccctcacttggtagatctaaacatgctggccttgtaaatttgtagttttgattgatgtgctgtacatgggcttttttagtttatatctagtattttttttttaattaactttcaactctcagcaaaataatttgatgtcaatgcttgcagaaattcaccaaatagttatatgactcgtatctaaacctatgtgctctatgaattctttctgacaatttgttaagttgctaatattctatcagtttgttaatgtaaagttgtagactataacaacatatatatccctgtattggtgtttgctttcatgcctatctaataaatgaatgtgcttgtacttgtgtatatccatgattttaaaatatatatttcaaaattatctatgcctatttatattaattcatacttatattttctaaattatctttattttttaaaattggtcgaactgagagaagaaaccaggttaactcctctcaactttattaattatgaagtttatatattggcccatcaaaatttaacggtcattattagttgatttgtgttggatatgttatttagtacgtaaatatgctcttttgtgttcttactagaatctcgagatttgccatttttatgaactgaaaaaaattattaatttaagcattatgaaggttgccctagcactccaaacatctgttatgtagtggttaagttaaatttctaaaaattgattgtacattgcctcaaatgtattgttagtggcaaaagactttaatttatatgcccagaatattcagaaaaccttgatcttaaggttctagtgtttgctggtgtcaacaagctcgtgatgaagtttagctcaacaaaattgctcaatagctctttgaatgtactaggaattgaatctttgatgatagtttcaaagtttatttttctcttttgcaatctttcatgcaaattaacagaagaaattttgtagaagacactttaaataatgtatggtaattgatcatatgaagagcagctgttatctgctttgacttatattttccactcctaacagcaatgggagggttcaattgatgttcttggtttgcaagatcggaccacaggatgcttcaaattttttcacaagtactactttgtgcttttgcttcccttttcttgccattctaccatagtgtccagtagtttgtatgatttttctttttggtttcttctttccatagttctaaactatgtacctgaacaatagctatcggcatttaaggtcacttcaatgggtgcaaggttgaatttccattgatgctgctcggcagaccatggaatcccttatacaggtatttgaattttgctttatgtgtgaatgattttggcttcattattagtttcaaagtttatttttctcttttgtaatctttcatgcaaattaacagaagaaattttgtagaagacactttaaataatgtatggtaattgatcatatgaagagcagctgttatctgctttgacttatattttccactcctaacagcaatgggagggttcaattgatgttcttggtttgcaagatcggaccacaggatgcttcaaattttttcacaagtactactttgtgcttttgcttcccttttcttgccattctaccatagtgtccagtagtttgtatgatttttcttttttggtttcttctttccatagttctaaactatgtacctgaacaatagctttcggcatttaaggtcacttcaatgggtgcaaggttgaatttccattgatgctgctcggcagaccatggaatcccttatacaggtatttgaattttgctttatgtgtgaatgattttggcttcattattagtctctgagcaatgtgattgctttgtttggtttggtctgtttatttacttgtttgtctctgttcttttatgcaatttgtcggacaccttagattctatctatttatctaattcataaaagctaatttatcatttggtcaaaagcttttatgtcaaacaagatatatattccacctatttatctgacccacagccctacctccctccttcgaagccctagccatcggagcactacgttgtcagacccgcaatgtcagacccgcaccaccttgcaccgtgagtattaacaacggcaacggcaacgatgacggagccgtcgccatcaccatcgtcacaccccattttcatctttttaaattttaaatatttaaaattagatttatttgattattttaaattaataatattatcaaaattaataatattattaataatattatttaaattaatattattctcgagaggtgaaaccactctaggaagctctctagcgagagtagccctactgccttcaatggcaggggtttgatatcgaatcatcattggatcggctctgacccactcatctactctgacggcgatcggagtaactcggcaattgaattctagaccttaggcccggcccaaagcccaaaaaaaattttcggaccggactcaaggaggccaacatgatacctttaaagtttacagtgaaattagataggtttagtgtgaatgaagaaatgaaattgcaaacagttaaaaacatgtcttagttcctcagctcacgtgcgccatcatatcctcggtatccctacgccacttctccattgtcgtcatccacttatcggatttcctacgctttgtcccttcctggttccccagctcatgccctccccgtcttatcctcttctttgtatgcctccttctcctcctctatcgataaggtgaggcagctttggaaggtatgttattccgtagacaatcggtatgcagccatcgttagatggaaaggagaagaagacaatgcgggagggatcttttccctaggctggcttctaaatttttctctcctcctgctcttcttctctgcatccctctctccttcatcattctttattttctttccttttaacttttgataaattgggacttggaaactctctagtgctatcttctagaccttgaaagaaaattctgtgttgccataccaagctgctttgccagctgaaatttctctagtgctggtaagtctacccatttcccttgaatcatctgatttttttttttaaatcatctgaatcatttaacattctttatgatgtcttgatactctcagattcgaacaatatggagtcaccagtagctccacatttacatggagcagtgtccaactctcagagcaggtaagtttattaataattttttttacttattttaaatatttatatttagaagcttcacatgtttaagcttgagttcgaaaagaggatctagagagtaaaagtttaatctaatcatccaatcgatggatcggaagtgtctatagcttcgtatcattaaataaaatatgtagaaataatctgttcgaaaatcaaaatagtatatcgaaatatacatcttcttatcaacatatatgctttcatatcaaaatttattgataatattttatttatttttgttacaagatgctaggacatccagctctcatctaccagctactgaagaggatgtacaggagcaggaggaggatgatagtaaaggttcaaggtcagaccaccatcgaactgactctatcccgatggtgccagaattagatatttggggccgcacgcatgttacactgatgtattcaatgagtctatagccatggccgacaggcccgggtaatcttcaaaagtttcatcgtgatggggacagatcattgcaataattgatcttcaacgtgataaactctaatactttagatatttttttttatattattttatcttttattatttaatataatattctttatgatgtcttgatactctcaggttcagacgacagacgacataaggtcaccagtgaccccatagtcacatgaagcagcatccgactctcagagcaggtaagtctattaataatttttttacttattttaaatatctatatttagaagcttcacatatctaggcttgagtccgaaaaaagaatctagggataaaaatttaatctaaccattcaatcgatgggccgggagtgtttatatcttcgtatcatcgaatgaaatatgtagaaataatttattcgaaaattagagtagtatatcgaaatatatacctctgtatcgatatatacacttgcatatcaaaatttatttataggatactgagacatctggttctcatccttcagctactagagaggacgtatagaggtaggaggaggatgagaaggatgatgaggaggatcttacataatttttttttatatatatgtaattttgatacatataaaatagtataaatttataaaattatataatttatattttaatataatataattaattttatatttatgattatgttaaataattattattttatttataaaaaaatttaaaaatattattgcttgttaatatgaacagattttaaaatatttaattataaattttttaaaaaaattaaaaactattagcaacggtattagcgatgacatctatcgtcactaataatttttaaatttttattaaaaattaaaaataattaacaacggtagtagtaacgataaaggccgttgctaataattttttgatattttaattaaaaaaattaaaattattagagatgatttttgttgctaatatcgttgctaattatcattattagcaatgaagattttgccatcgctaataatgataattaacgatgaaattattttcattgaatttttagcagcggcattccatcgctaatgctattagtgacgataaactgacaattagtgacgacaattagccgtcgctaattgtcaatttttttgtagtgagataaccccaagattaactagagccttaaaaacaaataaaagtcccaactagactaagccaaagagatatcctaaaaatcaatccttgagattttcggacgaaaagtcctagcatagactcagctcggatcgaaggaggtatacttagcttgatctcttggtgctagctatccagaaaaatccaaccaattaattaaaaatagaatggacctgcaggattggttacttcgattggaacctcggacaaatattatggatcaaaactagatggccagtgaggactaaagtttgccatatcaatcccctttctctatgaaattttggctatattcttatgggatcctcattttattcttatagagatatggttatatctttatttgacatctacgaaagtatctagacttatctccaaaatatcttagttcagctaatttatttatcgcattctgatcatataacggtctacctttaaatgtcgttataccatatttcagcatatccctaaagtgcttatggctttgtcttattttaacagagattctagatttaacatagctcatattattttattatggcattatgggcttatatcgacatgtctccaagggcattatgattttatctcagtttacctccaaagattttctaaattattctgccgatctcaagcacttggagctatctcagcctatctctgaaatgattatgattttatcttgactttcttctcatcactcaattttgctcaactaacctcaaattcttggtgtctatctctaaagatgctctagcttaatttagctgaactcaacatccatgagatgacctcgagttgctaggacaaatagttaaacattcggacaatgaccaaaaaaagacatgcataaaaaatgattctattgcattaacatttataatttgttattacaaaatggaacaaagaccaaataagattccattacaaaagaagaaggtcaaaactagctagactttagttttaaaaggtcgatgactccaataagatcacctaactcaaaagcaacatcaggaagcacaagaagacctacagaggtctactcgaagcttgaaggctccccaacaccattcctggaagggctgaagctactgagattctataaatctgcaagacaacagatattaattagtatttctatatgttttgtcaacattgtatgttgacattccaaagtcatttcatagatcaaggtctcagaataacaagtacaccactggtgtatatatgggagaaatcaatttcataaagatgaacaatgtaaagctcttcggccaattggagtttggatattttaacaattactttatcttccatatctgctttcactattctaaccgcattctttgttagtctatgcattattattattatctatgcattattattatccatagaaatttgattgggaaagtcatgatcgaatatttttctatcatcagcggaaacaattttagcattgcacagcactgatgatacagaccaaaatgctttagaaaattaaaatacaatagcttaacaacctaagttcaacatagggagggagattgtcaatcgcatattgctttatgctcaaccactttagcagaggggcctttctaaaattttaaaagcatcttgttattgataaaagaaggaatactaagtagggggaaaggaacgaaaaataatgagattttttgtcgatggattgattacatattctctgatacataatatatatatagctttaaaatttaactatataataaatagataaaatagagtaacaaccaactctatcaaaataattttttcgtaatttattagattttggcacctcaaatttgacccacagcagcgaagtccacaacagcaaaacatagatggaaaagcccataggtgtgcaagcctgcaagcgtggctcatgggcgcgcaaggcccgcaagcatgtggcccacaagtgcacaggcccgcaggcgtgcatggccagtgcgtgtggcccaagcactcatgcgtggcccaaaagcatgggacgtgcggcctagaccgtggttcactgcacggttcatgcgcggtctatggcaccatgcaggaggtggacacgtagtccatgcgaggtctacacgtggttcacgcagtctacattgcttgcatggaccgcatggtccaaaggagttttatcgcggttcatggaatggatgtgcgcgatccaaaggtcgagatggtgtgcaggggtgatccaattgtggctggtgtcttggactcccattaggactttgtcaaggttttttaaaggtctttttaaaggcctaacagcatatggcaaggtaaagtaggatccgtgagcattctagtacggtagagaggcataggtagtggctgagagcgctcgaaaagagaggattcatggccgagagcatcataggaagcatccaggggcatcagatgaccttgatacgtcaggtctgtgaaagagtgtctttgaaaaattttgtgagagcttttgtaaggggttatacttcttgttgaaagaaattgacgtatcagaattgagagaatatgatctcctcatgtacttgttttctttaatagtgaagcttacatgcccatagagataagccttgagctgatctatgtatttgattgtattttttttatttttcttcttccttcttgttggggaattgacaccatcacctgagttagtgatcttaggcaggagatctatattccacaatcatgaaggatctttcccaataagtggtatcagagcatgtggttgtccagattgcgacagtattgatcgagattaaaaaagatggagaagacaggattaaataaggtggagatcaaccggtatgatggaaaggacaatttctccctatagcaagcggggttgaaggatgtgctcatccaacaagggttgattgatgctctcttgtatgaagagaagccgactaccatggaggagaatgattggaggtggctccaaatgtaagtggtgaatacgatctgcttgacttgacgaatgatgtggtgattcatgtacttagcgagacttctctaacagcgatgaaagttcaaggagatgtacatggtgaagtcacttaccaaaactctttttctttagaaacagttctaccagctacgaatgagcgagagacagagcatgaaggaacatctcagcaacgtcccaaagatcctcaccaatctcctcagtgttggcgagaagatgaaggagaagtcagggcattggtcttgctgtcatcactttctcgttcttttgaatctttgataactggtcttctaatagagaagagcaccatcagatggatgaagttacttctatatttcttcagaaggaggttctcagataggagaactgagcttcaagttcaggtggtgattcggctatggtggtgactagaggaggtagtggcagaggataaaggggtaaaagatcgtaagatggatggtccagatccaaatcaagggacgtcaacaagatcagatgctaccagtgtgatggagttggggcatcgaatcagaattaatccacagctcagagatcggacgaaggctactacagcgtggtccatagtagcgataatgatgagatcgatgatgtgcttatggtctcagatgaggtatctacttttttttcatagtagattttagattctgcatgtttgcatcatatttgttgcagagaaaagttgtttgattctctagagagcagcaagggtgctgttcttatgtcggatggatcgagctgtgtgatcaaggatattagaactgtcagcttatagagtcatgatagaatactaaaaaaattagacaagatttgatatatatccaattttagaaataatctaattttactgaatagattagatttaagtggctacaagtagagagctgaggatagaatcctgaaggtttggcatgacagtaggattgtgttaaagagaaagaggtatgaaggatattatctcttgacagagagctcaatgtgagatagagtttcaggagccagtgggagctcagaatgaggtggagctctagatacagatggattaggcacgagacgaaagacttcggaggataacaggtgatgtcgcatgatgaagtttctattatcgtaggaggctattctgagcagatcacaagtcagacagatcacaacatatgatggagatgggattaagcggtctagctcgaatttcatatttgtccattaataagtagtcagatatttatcctagggcatgagagcaagattatccaaaaagctcttagagttagatagagaccgaatgtcgaatcgagatggagattgttagattttggcacctaaaatttgacccacagtagcaaagcccagatggaggagcttgcaggggcgcagggtgcaggcgcggcccataggcgtgcaaggaccacagacgcgtaggcccacaagcatccaaggctagcatgcatggcccgtagtaggcggcccaagcacgcacgcatggcccaaaggcgcgggatgcatggcccagaccacatttcatcgcatggttcacatgcagtctatggtgccacatgggaggttgttgctccatgaattgattttgatgattataaaatatttgaggaggtttctaataattttggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactcaagttggtgcttgactagccgagggatagtctacaaatcgatcttcacttttcaatgggtcaaactacacctattgaaaaactcggatgaaaatttttattcaagcacttaactatgatatgtggagtatcatagttaatggaccacacacacctactaagataattgatggtatagaatcaaccaaatccgaaagagaatggaatgaggttaacaaaaaaataactcaactcaatgctaaagttatgaatgttttatattgtgctttagatgctaatgaatttaatcgcatttcaatatgtatgtcggctaagaaaatatgagatagattagaagtaacacatgaaggcactaatcaagttaagaaactgtcctttatttgttatgaatgtaagaagtcagggtactttaggttcgaatgtccacaacttaagaaggatcccaagaagtacaagaaaaagactatgatggctacatgaagtgatagtgatgagtcaagctctgaagaaaaagaagattcatatgaacaagccaactcgtgccttatggcatataaaaatgaggtaaatactgaaactcttaatgactttatttttgaagaactttaagaagcattttatgatctagttgatgatttaaagaagttagggataaagaacaaagaattaaaatcaaagaatcaatctttactaaaagaaaatgagattatttcaaataaaaaattggtcttgatacaaaaaaatctgaacttgaaaaataaaattgttaagttaaaatctatgatagaaaagttcactcaaaattcaaataaacttcaaatgatacttgataatcaaaaggccatttatgataaagtcgatcttgactacaaccctttaaagaaataaaaatttttgaaaaatatctttgtgaactcatcaagcaacaagtttttaaatattacttactttaaatgtagtaaagtaggacacaaatcatatacatgtttctctagcaaatctgaaaattctaatgtgaagaaaatatgggttccaaaagaaactattgtgactaatcaaaaatgactcaagaaaatttgggtacctaaagtcaaaacttgatttttgtatataggtgtgtcttacatcccaagaaataaattgaaaatgatatcttgatagcgggtgctcaaggcacatgaccgatgatgaatcttaattcatcacacatgatgcaaaagatggagggatggtcatttttggagataatagcaaagaaaagatcatcggtataagtaacattggtatgactccctctaagtatattaaaaatattttattagtagatggtttgaaacataatctattaagcattagtcaattttgtgataaagagtacaaagttatttttgaatctttattttgcatagtaattagtcccaatgatgaaggcattaaatttgttgggcatagacatggtaatgtttatatgatagatttgaatgatcttttcaagataaacatgcaatgtctagtagtcttgaatgccaaaattaatgagactagttggttttggcaccgtaggcttgcacatattagtatgcattcacttttaaaacttattaaaaaagaattgattatcggtttacctaaattaaattttaaaaaagataaaatttatgaggcatgccaactaggtaaacaaacaaaagtctcattcaaatttaaaaatattgtttcaacttctaggccattagaattattgtacatggatttatttggacccactagaactactagtttaggtgaaaaatgatttgactttgtcattattgatgatttctctcattttatataagcttttttttggcatataaggatgaaactttttatgtgttctcaaaattttatcgaaaagttactaatgaaaaaaattttttaattcaaaatattcaaagtgatcatggaaccaaatttaaaaatcaagaatttaaaaaattttgtgatgaaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatcagcttaagtatctttctgatttcaagttctttttgataaaaatttattgaaccaaattttgaactcaattctcatctcttctttcttaaaaactctaaattatcattcatatgatcaatctcttaaatagacaccctttactcaagttttaaattttttcaaaatttttttatcatttttttgaatttttctagccatgaatcgatcctaagataaacttgtaattttcattaaaatccatcggacactcttttttttgaaaaatctccgttagttaagcaggctgaccctttgtctttcatcttcctcatcccatcgaataaaaattccctccatctccactctctcaatcgcaaaaaaaattctcttaaagtctctcttcccatcgggttttccccttcaatcgtccttttagaaactaaatccattttcttttttttcttcgtttggacggatcaagcttaccctagcttcaaaccctcttctccaaaccgatggtctatctctccaaaatctttatttttcttctaaaatccttttcactctacctctcattaggtcttctaagctgtttgcaagtctctcttgtctgaaatggctcccaaattgaaactaccgcagagaaaaaaatctgctcgtgggttagagaaggaagtgtgcagaaaaaagatggcagccgagtcctctcctactccaaccccactttcagatcctgctctagctttttcacagtccccacttagtccaagcaaggtaccactctccaatcgaaaagtagaacttggaaagaatatagattttaaattttttaaaaaagaaggattctcaattggatcaaaattaaaagtcaaggatgaaaattttactgtctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacagtaaagtctttagtgaaaggtgttaacattgttcttgatccattacttttgggataaatcttgcacttgccttgtgaatgttatactcatatggagctcccaatcaaagaagagggactaaatattattttaggaagagcatttactaaaaatttaaataaattagaagcaaggatactttcagtaaagatgagacttttgcatcacatgatgatcaaactttttatccctaggagtggtaggtatgacctcttatctggtagggatatatgcatcatataccatgtgatcaccgagacccccttgaaccttcctactctgatgtttgaggctatgagggagatcctaaataggtctaaggctcacctgccttatggtatggcactcaccctgatctttaggaggttcagagtctattttgaagggaaggcagtcaccagattatcacattctgacaccatcaaccgtcacacactgcaccatatgagtttttcaaagactgatggcggttggtcgaagggtgttgaggagagagcagaggaggagaaaatatcttcacctcctcgtgatcacagagcatctgctgatattcagttcgtgtttgatcacgagactggtccctcagagtcagtgaggagggatgcttctgtaccacagtcagggagtagagtagatccttcagatatcagacttgcagatgatcagattgagttgaattttcagcgtgttgcttctattttatcccagtagtttgccacctcagattttgctcagaagatgacatcttaggctgtttcagatcagattataatccctcatgtctctactatctttcagatgcttacagctcagtctgcacgacttgagtagcttgagggatatattctgagactgacggatagagttttagatttacagaggcaggtattagccttagcccatctccaaccgtaagagaacatcatggaggtctccaacctgtctacagaggcggctaggcttcgtggcattttggagagtagttttgatttcttaaggagagagtttagggactccaatgaggctgtctctactcagattggtaccatgatgcagtccatgtcgagagttttgaaataattggacatcatcagacttgctctcctaacacaacacatatcttcccaggctccaagaccttcttgtccttctgctcgtgccggtacttctacctgtggccaaggcagatgtggtcgaggatgtgcccgtggctttgatcttgagtctcttcatcatatctttgactcttctgattctgacacctctagccatgatatttattagatctagcattgttaatcttttatgtctaggatctaacttattgcctttgtatttgttggctgattgactcatggatagttgtattttttttgttatacttgacttttgtatggcctatgtattttaacttgactcttatgtattgtgacacttacgtatctgataactcttcagtcatattttggatatatatatatatatatatatatatatatatatatatatatatatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgtgattctaaattaactttaaaatttcaaaaatccaattcaccccctctcctcttaggttgcatagctgggtaacagaggtggatgtgcggtccatgcatggtttcatgaggtccacaccgctcacatggatcgcatggtccaaaggagttttatcacgattcatagcatggatgtacgtaatccaaaggttgagatggcatgcgggggtgatccaacagtggctggtgtcttggactcctatcaggataatgttaggattttttaaaggcctaacagcctgtggcgagtcagagtaggatctatgagcatcctggtgtggaagagaggcatagataacagctaagagtatctgagagaagaggattcatcgttgagagcatcatagaaagcatccaggggcatcagaggatcctgatatggtaggcctgtgagaaagtctctttgaaaagttttgtaagagcttttgtaaagagttatgctttttattgagagaaattaatgtatgagagttgagagggtgtgatcttctcctgtacttgttttctttcatagtgaagcttgcatgccccatggagataagccttggactaatccacgtatttgatcatgttctttttatttttcttctttctttctgttataatatcaataccatcatctgagttagcgatcttggacaggggatctgtattccacacttctgaaggatccttcccaacataattatctatccaaaactatccaactaaaatttttaattcaaaattaagtttatctttttaacatcctcctttaaactaaatttcttttatcaatgattccaagtgaatcctttaatttgcaaaatacttcaaaattaagggactttatgaaaatatctataatttgttctctggacttgatgtactccaattctatctccttctttttgacttggtcttgaataaaataaaagcgtacatcaatgtacttgctttgttcatgatagacaagattcttggctagtgcaatcgtcaagttattgtcaacacagattctgatagcattaccttgcggttgttatattgccttcaaaagatttcataaccatatggcatggcatgcacatgaagaggctgcaatatattcagcttcacatgttgaaagcaccactattgattatttcttcaaaatccatgtaaatacggtgtcacgcaaacaaaatatgaatccaatcgtgcttttttgatcttctagatctccaccccaatcattgtctaagtcacaaactaaataaaaatcattaaaaatcaaatagaaagatccatgattgagagtacatttaatgtagcgcataatccattttgcaacctttaaatgtattgactttggctcctccgtgaagtgactaattagtcaaatactatataagatgtccgaccttatgtatgtcaagtacctcaagctcccaatgagacttttgaaatatatcgagtcgattgtcgctccatcatcatgctttgataatttggtcccatattcaatcactgtacaaactgacttgcaatcctctatcttgaatcttttgagtatcccctttgcatagactttctgagatataaaaatatccttcttactttgcatgacttcaatcctaagaaagtatgacataaggccattgttcgtcatctcaaactcctgaatcatggcctgctttaattctttgaacatcacagattgttatatataaaaatcaaattatctacatataaagagattagtaaaatatcctctccattttttattagatttcatgtaaaggatgctttcatagaagcactggatgtagccattttttttgaagtatgtatcgattcttacattccatgcccttagtgcttgttttagactatacaataccttgtttaatttgtagacctttgattcatatcctttatcacataatctgtcggttgctctatatagacctcctcatcaatatagccattcagaaaatctgattttatgtccatttagaaaatcggccatttatattatgctgcaatagataaaattaagcgaataatcttcatatgaataatggggtcaaataccttattatagttaattcagacattctgtttgtatcctttagctactaatctggctttatatctctctactatatattttgcattcttcttcactttatacacccacttcacaccgatggctttttctcctttagaaagagtagtcaactcttatgtgtggtttttctcgatatggctttcatctcttcatctatggcatacttctatattttactttttatagcatcttcaaactcaatagactcataatctacaaagagacaaataaggtgtacttcatttgttacctcatatagttcttttaaacttcttatcttttatggtgctcttggattgccatttgatgatgaatccgatgaagtggacgatgatggtgtgggtgaaggtattggtgttgatgatggtgtagtagtggatgaagatttttcatcttcaatccaagcaggctcatctcctatgatctgatcgatcatgttgtgacaactccattcaccttcctcattaaactctacatctctactaatcataatttttgaattattaggatcaaataatttataagctttagatttagtgccatacgtgataaagatgagctttgagcttttatcctctagcttgactctcctctgcttcaaaatatgtgcaaagctatacatctgaagatcttcatgtgtgagatattttacttcttttccattcatgcttcttgtggggttttattctccaagcttgttgcaagacactggttcaaaatatagatggcgtaagctaccacctcggtccaaaacttctttggtaaatatttatttttaatcatgcttcgcactatattgagaatactgtggtttttcttctctactatgccattttgctaaagcgagtaaagagcagccagttgataccgaatcctattctccccacaaaatacttcaaatgaattgaaggtgaactcgccgcctcgatctaagcgaatgactttgatagaatagccgctctcattttcaacaatcaccatgaacttcttgaacatattaaaaatgtctgctttctctttcaaaaaatatactcaattttttttgtacagtcatcaataaaagttagaaaatattgatgcttatcaaataatatgaggacataggtccgtatacatctatgtcagtaagttcaagcagcttctttgctctgtatcttgcctcatgtgaaaagtatcttctaggttgtttgccaagaatacaaccttcgcacaattggtcaggatggctgatatgaggtaatccgtaaccatctgcttatttgatgacacattgagatcaccaaaattgagatgcccaagcctcaagtgccacaatcatgaggcatcttttacatagagtttcaagcacttggctacattatttttaatattaagaatgaatatcctgttctttgacttctctatttgggcaatcaagtcattaatattatttctcaagtaaggtttcttatctttcatatggatattataatcttttttaagtagttgtcccaaatttagaatattactattgagtggatgtctggccaggacaccacctctcaagacctcttcggtactgcacgatacagcaggaagaaagaagaaacaaaatagaaaataatcaaaatacgtggatcaaccacaaaaggactcgcctccacggggcatgcaaactttactacgaaaaaaaaattacaagaggagatctcaccctcagctctcgtacacccaatttctccctcacataaagttttttctcacaaaagctctctctcttaaaagaccccctgaatccctaaagcgaccattgttcgctgtccagaagcctcctgctccttctctcacagtgtcacacggctctctctcttctctcaggtctctgatcttcacgtcatacagaaaactcaagtcacggattctgttttcatgagaaaccaagccaaaaaagaccaccaccccttctgttcacagatcaggcccttttaaagggcttaaacctgaattagattaggtttaggagtcctaaaccaacccaattaagaccccaagctattggatcatgaccacaagccaccagagatgtctgatcatgatcgatccacaaaatagtatcgtggaccgcacaaaatgcatgggaaatgcccatgcagtccacagacccgaccgtggactgtccagtccactgtggatcggggtacaggccccaagtgcggggacctaggcctgggcaggcccgcacgtgnnnnnnnnnnnnnnnnnnnnggccacgcaccccacgtcgggccgcgccctcgtgcgcctggcccatgtgctgccacgcactgggcggcatcccaccgcctatggtcgcaccgctatcactccgtcggctcgccgctggccgtcggcggtcctccaccacctcaggttgcttgctgactttaaaagtatgtatcttctccgttcgagcttcgtttagggtgttcttgatcttattggacttcatttttcatcgcaaacctcgttgtggactcaatatggatcaaatctcgagatatcaaattctaacaatctctatctcgattcgatattcgacctcctcctaactcctagagcttctggatctcctcacccccataccctggggcaatcacctgctgatcatggataggcaaaaatgggagttgagccagaccgctcgatcccatctccatcatatgctatgctcctcttgacctgagacctactcaaggtatcgtcctacggtaataggaatcccaccttacgacgtcgcctctcattctcccgagtctcctgtctcgtatccgatccagctccacttacagctccatctcgctctcgaagctccacctggctcccgaagctctacctcgcattggacttcctgtcaggtaataatatcctttgctctccttcttcccctccagcataatcctatcaccacgtagcaccttcagaatttctccatcagctactgtcctgtagcctctcgaatccagtctgctcagtgagataagattccatctgaaattggatatgtatcggatctctcctaatcttctcactataccatcatgtgtcctccaactgaccattctaatacctctgatcgcatagctcgatctatccgacagatatacagtaccttcactattctcgaaagagtcaaactgctcctctctgcaacatacatgataggaacnnnnnnnnnnnnnnnnnnnnnnnnnnnnnnnnnnnnnnnnnnnnnctgaatcgctaccggccgtcgctacagcagccaccatccaatttttgagttgagagcaatctttggctagatgctccaactcctcacaccagtaacacctgattttgcttaagtccctcctggacttggaccgtcctcatcgcgatctcctgtcgctccgtctaccaccttctgctcctccaaaagccaccaaagttgagctactaccatctgagctcgaagctgggttctccctcctaagaacctcattctggagtatcgtcgtggtgacctcatccatcttgatggtgctcttctctactagaagagcagtcatcaaggactcgtatgaagatggaagtgacgttagcaaaaccagcaccctgatcttctcctcaacatcgtcatcaatgctgaggaggttggtgaggatcttctgaaagtggctgagatactcctgcatgctctgtccctcgaccatccgtagctgataaaactgcctccagaggaaaagagtgctggtgagagacttcaccatgtacaactcctcgagctttgatcaagcaccatcggggaagtctcgctcagcacatgaatcaccacctcatccgttaggtatatgcggatggtactcaccgcctgcatctgtagccatttccaatcccgcacctccatggtggttgacttctcctcgcacaagagagcatcaatcaacccctgttggatgagcacgtctttcacctttgcctgccacaaggagaaattactctttccatcaaacttgttaatctccatcttgattgttcctgtcttctctatcttcagtcttgctcaccaccgctgcaatctgcatccttgtaccaccttgctctaataccacttgttggatagatgtctggccaggacaccacctcccaagatcttttcggtactgcacgatgcagcaggaagaaagaagaaataaaataaaaaataatcaaaatatgtagatcagccacaaaagggtccacctccagggggcatgcaaaattcattatgaaaaaaaattttataagagaagatctcaccctcaactctcgtacatctaatttttttcttacagaaagtttttcctcacaaaagctctctctcttggaagatccctctgaacccctaaaacgatcgttgttcgctgttcagaagcctcatgctccttctctcacagcgtcatgcggctttctctcttctcttggatctctgatcttcacgtcatacgaaaaactcaagtcacgggttctgttcccggtgagaaaccaagccaaaaaagaccaccaccccttctgttcaccgatcaggcccttttaaagggcttaaatctgaattatattaggtttaggagtcctaaaccaactcaattaagacctcaaactgttggattatgaccgcaagccaccagagccatccgatcacgacctgtccacggaatagtaccgtggaccacacgaaacacgtggaaaatgcccatgcagtctacagacccgaccgtggaccgtccgatccacggtggatcggggtgtaggccccaggcacggcgcctgggcctaggccggcccgcacgcatgggcctgggccgtgcccgcgctcggcgcatgggcccatgccgcgcccccacgtgcacacgcgcttgggccgcacgccccacgccaggctgtgacctgcgtgcttggcccgtgcactgccgcacgctgggcggcgtcccaccgtctgcgaccgtcggcctcctcgtgccgactttaaaagtacgtatcttctcttttcgagctccgtttggggtgttcttgatcttgttggactctatttttcatcgtgaacctcgatgtgggctcaatatggatcgaatctcgaggcatcaaatcttaataattatttttcatcttcgaaagataatatacataaaaaataaattgatgattgttatctttgaggcagattagaatttacttttttctttcactggaacctttgaggaatttccaaaagagacttgtttttccaccgattcatctaattttgccaacatgcttctatgaccgcacatatgccccaccatccaagtaccaactttcttgtctattggcttcattttctttatagactaacaataataaaggatcctcttctattttttcaatataattaactacttctttaacttgattatttttattataaaaatactcaaaggaataatatttatattttttacaagtataacattgaatctcatatttatatctctgattttttgtatctgatctcccatatccaatattttgatttgctttatctctacctcgtcctcctcttccatggtcacggccatactcgtagtctctaccgtgaccttgacctctgccatggccttaatcgcttgggtttccatcattctttgagctttcctgtgcttcttttaatgagagcttcatttgaagagcatgttctactgctttctactttttttttcatgtgatgctcgtgggcttgcaatgatcccataagctcatccaccgatatcttttctaaatcttttgattcttcaatggctgcaataacataatcaaatttattatctaatgatcgtgaaacttttttaattattcgaatatcttccagcttctcgctattcctccaaagttggttcacgatggtcagaagtctggtgatatagtccaagatgctctcagattccttcatccgtaaggcttcaaattctccttgtagcttttagagatgaatttttttcatcatattaacgcttttgtaggccagaatctcccacactttcttggaagttgttgcatggagatcttctcaaattggcttcatcaatgccttggtagatgaggaaaagcaccttcttatccttcttccttaaatctcatagggtcttcatttgaatgctccaattttcataattctccttcatgagggatggtatttgaggttgcatgcatgccattcaccaaggggaaaggaatgggaccggaatgaaaaataagaagattttttatagatgaattgattacattttctccaatcaattatgtatacatagctagaaaatttaactaaataacaaataaataaaataaagcagcaaccaactttatcaaaataatctcttcatatttatctatccagaactatccaactaaaatttctaattcaaaattaagtttatcttttcaatggttattcacgaaccttaatgaagatggatgattagggccacgtaacatgaaaaataaagttttgagatctaaataaaaaaaaatttaagttacctctttaatcatttactataaaaggttatttatgcctttttgtatagtgtttgggtggtgagtttataactttacgtcatctattctctaaccggtgcccaagtagatacttgaacatcgcgcatgcttgagccagggttgtgcttttcttccaggtaaattcatttcgaggaaagaagcacaacttgcttagtcgagaaggtgaatcagatttgagcattgcttaacctcttcccaagaagtctgaaacttattttgtttgggttttttttagatcagcttggatatacctaatatataaagtatcaggtaggatgatatggatataaactatacaaacgcgctagtagactaaaagcttgaaagattagtaatttgcaaaggtgatggcatcaatattgtcataatgatctcatgctttagatatctactttcagagcggagacacaagatggttaggtaatagaaatttttttttcttttccttttttgaatgcaacaggtaacacactgacctttttttaaaaaaataaggaaaatggtgggagtcggctagtgaattggtaatgtgtaactgtgactgtctacgagacatttataacataagaaatagttaaaaaaatgaatgcagtaagtcggatggatttggcaaggtctattgttctatgggcttttaaagagtgagattcgatcctaggttttctttattttttttccctttcgggtaaaaatctcaggttcttttcttttgtttttttccccccaccttgaagaagagtggagtctatcgaaacaacattagtgatggttcaactcacatattcctcgaagccctaaaaaaaaaatcaactagttctggatccaattgcaaatgaacgcactggatctaaattgaagtccttgggagctaaatcactctcggtgaagaggaatccgattatctatgttgaacctattattatttaatcgttgaacctatcattatttaatcgtaatagataagacacgcctcttgttcttcaaatatggagaaataataaaaatgtaagaaaggtgcaagcagataaaacccaggttaggtggactacaaaaagttaggtgggtcttttctatgtttgaaaaaaaaaaaaatggtggggggagttaggtgggtcgacgagttatcaaggcgagggatccgtgtcaaaacggttggtaaaaccagcgtacatgctttaccaacaaccactttgatctccactttattgtttaatttaagtgtacgtaatgaggagaaaaagactttaaaacaggtagctaaaccatcattcccttgttcggcaaaacgtctgcttttactatatatgctgctttaaaaaaatatatgtagtttgtccatattaattttgctggtagaattactacattattcaatccctctaaaagaaacatttgataataatctgaaaattttggttgaaaagaagttgaagcatggctaaaatagaattcatataactgcccaatttggtggacgagttgtgtacgtttcttatgctacacttagtaatattttttttacatcttcaaagggaagtgtccctcaaaaaaagacaataaaaggaagtgatctccttttagaaccacttcaattattcgcctcgagccgttatatacaatcctttttcgttttactcttattctgtgatataatatggtacttcgtggcgtcattctgaacgtcacactcaggcgaggctgctcgtgcacgtgtagcttcccagcacccgtgcgaaccccgcgatctccttcaagcgtgcgagcgcggcctccacgttggtatccgacgcgttcccatccaaatccaacacgaagacgtagtcaaaccgcgcgatctcgcccgcctcctccctctcctcgactcggaccggcttcgaccggttgggccggtggtctacccgagcgacccggactccccggctctcgaagatccacatggcccggaagaggtccgagacccctcgctccagcgagaaggccaccgtggtcttatgattattattatcattatcatccagattaggttcactgacgacggctccggtcgagccggcgagtcccagctggaggaaccggttgaagttgccggcgaggtcctggaagttgttttcgaggacccgcagaccgaactcgtgggcggcgatctggctgccgatgacggcggtgtcggcgatgcggttttcagcgacgaagcgggcagcgtcggcggcgctggcgacctcctcgacttggaggtggagggcacggaggcggtccctgcagtggctgatagcttggggatggctgacgacgcggcggagggcggaccgcggggcgtgagggagggagaggaggcagtggttaacggggaggacgagctcgccaacgatacagacacggggatggcggaggaggaggtcaaggtttcgggggacggggccgtcgacggagttctcggccgggacgacagcgcggtccgcggcgccatcctcgagagcggcgaaggcctcctccatctcggagcaaggaatgatgagagccggcggctgctgccaggaggaggaagggggaaaggctttggcggcggcctcctggcagtaggagccccggccgccctggtaggccacgcggacaggggggcggccgccgtgatcgccggcgtcggcggcaggtggaggcgggtggcctcctggggcctggcgaaagaggcgttcgaggtcggcgatcgtgatctcgagacccagcttggaggccatgtcctcagcgatccgcagaggagatgatcgaggtggaggaggaggcctgatacggacgacgtcgtgtgtcctcctcctctttgtacttgtcgtgtgttgagactggatataacatgcggaagaagctttaaaaagcgcgaccatatttacgtttaggtagatagatagatagatagatatgatgacaacagagagagagaagcagagtggaatggttctaatttcgatctgatggatcgctcttctcctttgccgccgccttcttttttcttctttcgatcgccttcggtctgttggttggttcaacggagataggagtccaagctcgcaacgcaaccgcggaaagcggcagcagaggccaccgcgcagagatcgcgtgatgaaacgatccctggctaaaaaatgtgggagcgcgggggcggggtgtttatatctgctgcgatgatggggttgggtggtagatgaccacatgtcacacgtgagaaacagagaagggtgttaggtgggagcgcgtgcgtgcgtgctcgtgagggagataattgtgtgttcgattttgttttgtggtgtggaaggctgggacttgactagtgtatctgttcgttgatctattaaatttattaggtttgaagaagctaggaaagaagagccccgttgggtcagaggttgcatcatagtttgtacctaacccaaacgacaggtacctacgtaacgtgcatgcttctcttttggaatttacggctggtgaaatcagatcagctagtttataggagcccttatggccatgctatacatttcattcgttcagcatggatgatatgagaataaaacaaaaacatggaatgagtttatgaaatcaacaagatgtacgttttgaggcctgacaatgcactgcacggcgtgagctccttcgaaaaaaactgctgcttcgagtctccgatccgaggggagtgcagctgaggttggatgctgatcgggagccgaggcaccaaaagagaatttacaaaaagaatacatattcatcattgaaaatctatgattaaattaattagaatttaaaaataataataataaaaaaagaataggaaagagatgatattcttctcttagattgagcttatctcaagatttttttggcatctttttatgtaaaaatggagccacaagcagttagctagaatctattagatctaatttttgtgtttggtagctagcaatcaatccaaattgttggcaatttaaagaagccccatcagattatcacgtttggtataccttttggattggtaatctggattatcaggtaattcagatcacctcctatgagataatctggattgctaagggaagggatggctatccagattaccaccactttagtaatcttataaaaaaaattttggatgaaactaccctccctcctccccgtgtggcgtccttctcaacctcctctgccgcttcctcttcctcttccccgaaggcctcctccaccatcctcttccccggcggcctcctcctcaacctctccggtggagctggatgaggcaggagatgtccctggagacgtgaaccgagggtagggtgtgggcgaggaaagcgttccggggacaagggatgtggttatcgagccagatgtgttcgcgcatggcccccgaccgccaccacaggtggaggaactcccgacgctacggtcagagctgggcagagccgacgatgccgaagatgacatggcagaaggaaaacggcgtgcattgtcatcttccagggagggggagctaggagaagaggcactggcagtggagtcatgggtggtcggagggtagcacgggcggcacagacggtcggggggccggggtgcagtggccagggtagtgtgggcggtcgaggtacaatatcggaggtgcgacgggcgggtgcggatgtgtcaaagtgccaggaggcgatgcgggagagtgggaggaggcacggaaagccggggggggaggagggcgacgggaaggcnnnnnnnnnnnnnnnnnnnnggaaagccgggggggaggaggcacggaaggccgggggagggggcagggggggaggggtgtggcgtgtgagggaaggagaaggatgagaaaaaaaaataaaataatataataataataataataataataataagtattataaaatagtataaatttttttcatataataatttttatcattaaaaaaattaaataatagtttaaaatgctaaactaataatttgattcaagagtattttaaaagtttgatgttatattaccaataatctgattgtcataccaaatatgtcaatcaagattctcaataattttactataacattacctgcatataccaaacacagtaatcaacattactagtaatctatccagattgcaagtaatctaaattaccaggtaatccagattatcgttgcctgacaatgcaccaaacataatgttaggtcattaggtcacattttgatagattattgggatagaaaatttttctactaacctacaaatcaaaattgttaaacaattatggattttgcccatgtgggtagatgagcttgaagtctaaggtcgacatagagctgaggctccatactgatggctatatttgatgtcatctcccctcttatcagttgtggggcttcattttctatcttcggtgagatctaaccataggattggtaatgttccgaccataggctcatcgatatcggaactgaagtttggtaggaggccattgacaaagagtcggtccgtcttgttttcttgactctctccgatgttcgaggtaggctcgtcaagtcatcagtgagtgctcgattatgttctgaggagaggaaggttggttcagacagtaaattatcttcataacgtttatcccctactttcgagtccgaagtgatttcactgttttggacaaagaaaatagccaattttcaaaccaatctttgattgccaacctgacctccttggagcatttatcctacaatattcgatggaggaaatctcgaagtctttttaatgcatcgctttgtaatccatatcatatttatgagggatgagggcttgaggtactacatagaaataatttgaaaaaaagagatccggagatcattaatctcaaatctgtttggacttgccatgtgttaaatattgataggccccaccatgtggctcacaaattgtcttatgtggctcgatttggggatgatatgatgaagagtcgcaagatccgtcgcttctaatgttggccaagtggagagatccgacaggccaagtggagagatccaacaatttggtagttgaatttatactactagtagtatgtataaataggctatttcccattatcttcttttactttgttctaccaaattctctataatctatcatcgttgttgctagaggaaagcttttcccttgctgatattatcttcaccgacatcgatggctgccttgttcttcagttggtcctccatccctctccattcttgcttcttattttttttttgatttagcttccttcttcttcgcccctttttgagtcttctcctttttctttgctacttcagtctttccccatgatattcttttactattcatgtcttccgacggcaatgagttttggagtgaaaatccctatggcaaccacaatcgtaggccatcgcctccctagatccggtttgaggataattctcaggccattgttgtggctggctcctcatccagggactagatctccacatcccatagtgcaggtagtcctgtgtgcgagttcaaagatttctgcgattcaggtaacgaggagtcaaacattactcaagacaacccgcaaaaatttcggactcaattttcaatttcctcgactttctgactaaaaattttgaatcagaatgatcgagttaccaatgctccgaagggacaagtcgctttgtatgaggagtccctccaagccagtcttcatctccctctttaccttcattagtagtattttttgatttctatgggatccttctaacccagatcacccgaaactctacttgagtggttgtcattttcataattctttgtagttggcttcaaattcctttaaggtgctcacttttcatagcattatttatcttgaaattttcatgaaaaaggatgatggtacttctctccttgaatgaggtaaaagtttattataagactgtcctctttggtgcacggttggaagagccatttctttattgtctccttaaatcttccttggggcttcagttgggtctagggcgatccccatctttccccaaacaaagataatctattctgtccaaggacaagatagcttattagtgcctgcttgatgttgagatatcagaattgaaagagttgctaactaagcagaaccttgacaacattggtaccaatctagagttacctcggggtatgacgttctcctttatttaagaaaatttttttgattactactaaactaaccattttcctcctcgattttatagtgatgaggccaacccttgtatgtatcaaattggccctaaagaggcagtcaggctcctctggtggtgagccgtcatcaaagaaatcaaggatagaaatggcagtcaaacggatttttccgagtatctaacccattccaaatcctattaggatccatttagtatatcctaatagagtttgagatggatttgagatttaaaactaaaatccatttgggtttggaatgggtttaggatttaacccttgggtacccaccatccaaactcgtttatatataaataccaatataaaatcctaatcaacatttaagcttctctatcagccactccatgcttcccacccaattgagactcttgaggatggaaaaatagagggaaagccatgggaaaacaaaggaaatgtccaggaaaaccaagaaaaaaggaaaaaattgaaaggtaagatcttttcccacatggattgatcttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnttnttnttgccttctttttttttcatttaagtttcttcctttggagatccatggaaaaggagagcacttgagggagatgggagtggtttcttagctcccgttaaggtttttctctagcatatgagattttgtgggatttgtggcggtgtgagttagtccctttaggttttgagagcctaatcctggtataaacatgatattttgtatgatttgggatatttttgatcgaaaggctccatgtctcccagctgattgaaactcatgaggatggaaaaatagaggaaaaatcatccatcgaaaaacatagaaaaatcaatgaaaaaggaaaaaagattaaaaggtaagacctttttccacatagattggtatttttttttggctttttcttcttttcatttcattctctattttggagatctggggggaaggagagatccaaaggaaggttggaggggtttttagattccagttgtggtagtttgagttggttccttgggtttttgagtgcttaatcttggtagaagcatgatactttgtaggatatggagatttttgatagaaatgatatattcttttttgattacaaaatttttgatttatagatctattgtcatgataatatgaataagaataaggattagtcggataggttcggatacctgatgggtatacaaatattaaatgggatagatttgggatttttatttaattttgtaatcgggtttgagatggattcaggtagaaagattttaaacagcttcgaaaatgggtagggcaaattttgtaggtatcctatccattgccatccctaaaggaagtcttaactgagaatttctactcctccagcctcagcaccatcttcaaggatgtcaagtactgacccaatggaaattgaagatgagctcacactggccatgcctttgcaatctgccccaccatcaagtgcgaagtccacccaagccctatcttatgttgaatggacaccatctttacctagtctatcttcatcgcccttatctctcattgcaccaggtaggccattaagatctgaggtggaccccacctcgtctgcgatcaaggaggaatttattatcttggagaatagagtgcagagagattattctactctttaaaatcatcagcttgcttgggagtagatgagaatgattcaattattaactgactagtcagaaaagaagacccatcctttggacgaggttattagcaatgcctaagccagtctctttggggtaagtttctaacttgcacttgtcttcgattttcatatgtgtagttactcaacttgtttctctgtacagttggggcatgacatctcagtccatagtgagagcttgattggtttcaaccaagtaaagctctcacttgaagagaagattcgggcttctgatgccaagtgaggattgcaaaggaggcccgatagacagtcgaagaagaagttttctaggccaagtccaagctgttggttgcctaggagaaatttgaagctttagaggacctagtgaggcactacagcaaaaggtggccgagcttgaaggagcattggagcttgatgcggcttcaatcaaggctactgaagatagggcaatgttggttgaggcttgagccgagaaggagagagcgaaggccatcactgaggcaaagcttaaggcaatcaaggagttcaagacttcaacaaagtttgaaaatgaggtcgttgagggctccttttttggcttgtaagtatggttttgaagcttacaagaggtgtttgacctgaaggcttcctaagttgggcctgggtgatcttcgtcccaagaaaagtaatgatgagggtgagccctcatcaattatcgggggtgaatctcccgcaaccgtcgagtctcctactatcgagccgaccattgaaggcatcgctatcggtcctgctaccgagcccattcccacaaaccttgattaatcttatatcttcttatctttatacttagtaaactcttgtaatgacttttctctttaatgtaatgaactttttttattggtcttgtggattcatttgacatggtcagcaatttgtccaattagcaagatttgttacttcgatcaacctcttgagttggttagagtatagaaattcttagacttgtctctcctgcaataatgtatgggatcggacagaagttgatttgaaatcaaaattttcattgtcaatttgtgacgatcttgccaagtcattattaccatcctcgacctctgctcgactcgtccatagatgaggagcgccaaatggccatgtagagttttcgaagggttagctcctttatagtcatcattagcctttgctcgattcattcatggataaggagcaccagatgccatatgggatctctagaggattagtccctttataatcatcatcgaccttcgctcgactcatctgtagatgaggagtgctatatggttatatggggtctcagagggttagttccttcatagttgtcatcagcctccactcaactcatccatagacaaagagtgctagatcgtcatatgggatcttcagaggattagtcccttcatagtcatcgcaagccttcgcttgactcatctgtggatgagaagcaccaaatagccatatgaggttctcaaaggattagcccttcatggtcatcatcggcctctgctcgactcatctgtggataaggagtgctaaatggccatacgaggtctctggaggattagtccctttgtaattatcatcagcctccacttgacccatctatgaacaaagagcgccagatagctatatggggtccctagagggttagctccttcatagttattgtcatcggttgattctaatgactccatttgtggtcagctagcatcgatatcagtcgagtattttcattttaataagaagtctgcattgatgctcagggaattaagaagtttttatcaatataatcagcgaacatacaatttactggtagtacaaaaacttcaaattctcgatgttccatgtcaaaggcataagagttacatcaaaactttcaatcctgtatgctccagcctgatgactttagcagttctgtaagggccttcccaatttagagctaacttatcctgctttataggcttcaacactacagcccaacggaggatgagatctctgggttggaacatcttcaatcaaatccaagcattataatagtggtctactcattattgatatgatgccattttgatctgagcttgcttcctagttttttcgaacaagttcaagttcatttgaagtcagcccgaattctcttactcatcatagtcctccaccctagtcatcagcattctaatctcaataagaatgatccgaaggtgaagttgaatggagtctctcctataaggatttaaggagtcatctgataagcccataataccttataaaatttttcgatctagagccctttggcttgattgagccttgatctcaatgtttacagatcacctcagccttaccatttgactgaggatgaccaagtgaagtgagcctatggtcaatattcagttcggagcagaatcctttgaacttctgattattaaactgtagcccatagtcaatgataatggctcgtggtagtccaaagcagcagataatggattctaaataaaatcctagaccttcttcttgataatttaagccaagggctcgacttctatttatttggtgaaatagtcgactgcaatgatcaaaaactttctctaaccagtggtcatcaggaacggcctgaggatgtcaatttctcacataacaaagggccaagggacaataattagtgcaagctccatagctggcctctgctagctattggcataattctggcactgccgtcggttgtatcctattgtagagtaggccaatagtactcttgttggattatcttgtaagccaatgacctaccctccaagtaattgtcatagattccttcatgaatctcccagagtacataatccactttgatcaatcacatacaccaaagtagaggtagtgaatatgattttttataaagtctctcttctaagtaaacactcttgggggcttggtgcttgatcctctgagtttcaacaggactggttagtaaggcaccgttaagaaggtagttgattagagggtccatttaactcggttcatggttgatctgtcggataattggttcttcctcgatgctcagtttctacaagtgttcaacaaagactcatatattgaggtcaagacatcccaaagtggcaagatgagataagacattggcttggatgttctctgaccttggtatatgttgtaccttctaattttagaaggcctctaagagttctttgatcttttgtaagtaccgagccatcttcgatcctcgagcctcatattcttctcaaatttattcgatgatgagttgcaagtcagtaaagtctcttagatcttttatcccgagttctttggcaatgttaaggcctatgagttgcttcatatttgaccttgttgttggaggcagtaaagtcgaatcaaagtgtctattccatcacgtcccctatcgggcttgcaaggatgagtctaaccccacatctttgaaaatttgaggctctatccacatgaaggatacaacataaggctcccacctctttggatagtttcgacgtcgactcctcatcaaatatagtacattccataagaaaatcagctagaacctaagcttttattgttgatataggatggtagtggacatcatattcttcgagctcgattgtccatttcaccatctaccccgaggtgtcgggtctttaaagaatagcctttaaaggttggtcagtcaaaacaatcattgaataggcttgaaaatatgatcagagtcattatgcagtggtgaccagtatatagattatcttctcgacctttgagtaccttttttctgcatcctggacaagcttgctagtgtagtaaatagatctttggtttctttcatcctcttgaaccatcacagagctaacagcaataggtgagaccgataagtgtaaatataaatcctcacttgtcaacagcttggagagcaatgaggatgatctgagatatcgtttgagctcttcaaatgtaatttggcatttcttcgaccactcgaaactcttcatttgcctgaggatattgaagaatggaaggtacttttttcgaccgacctcaaaatgaatcgattgagagcgaccatctagcctcctagctactgcacatcccctcttcattcttgggtactttattttcaggaatactctgatcttctctaggttcacctcaatccccatcagattaccataaatcctaaaaatttttttgatgtcacaccaaaagtgtacttactgaaattgagcttcatttagtttcacctcaacccaaccaatgcttcctccaaatcgatgatatgccgattagcttcagtacttttcactagcatgctgtcgatagaaatctccatgttgcatttcatctcgtgtttgaacactttattgatgagacactgatatgtagcttttatacttttcaacccaaaaggcatcatttgttagcaatacaaaatttaatcggttatgaatgccatcttctcctcatctttggaggccatttgaatctgattgtagtcggagaaagcattcatgaagctcaagagttgattgttgggaggatctctcatgagtgcggaatatgaatcttcatccaagatcgcaatgctagtgacgatgtcaatactacaagaggaagaaaaaagagagacaatcaaataacgtggattgactcaagacttatctccatggggtatacaaacttcactataaaaaaaataaatacaagaaaagattacatcctctcaactctcatatatcaatctctctctcaacaaaaagcacacaaaattctctcataaaactctcaactctcacaggaagatcctctcagctactatctctaagactctctgccgccacacatgatactcaagccgtctgcccccttttaaagcccttaagatcgtgttggcaatgcgtacacaagtcctgttaggattctaagtctaaaccgtgtctagaaccacctatagaccgcagtagaccaccatagacccctccacatgaatcgaagccatggaccagctcctcttcatgcgccacatgtgccacgctcaccctcgctcgtgtgcatcgtgacaaagaccatgcatcgtgcggtggaccatgtgaggaccgcatcgcccacatgtggaccgcaactcccgcactcttggacagcatggtggtccgtgcatctcgtgcagcctgggctgtgcctgtgggcctgcgtacctatgagcctgtgagcttgcgggccgcattcctgtgggcctatgttgtgggcttctccatcttggacttatctattatgggttttgctggtatcgatcgaattcgaggcatcaaaatctaataatctccatcttgactcgacattcggcctccacataactttgagagcttctggatgatcttatccccatatcctgggataaatacctgactgctcatggatggacaaacataagagttgaaccaggccgctcgatcccattttcttcatatactatgacctgcttgacctgagatctgctcgaggtagcatcctatggtaatagaaacttcattctgcaacatcgcttgtcatcctttcaagtcttccatttcgtgcccaatccatctatatctagagctccatctcgaactgagctcccactggcacctgaagctctacctcatgtcaagctctctatcaagaggtagtatcctccatacttctttttcttcataacaactctactgccatgcacaattttcaggattccatcatcaactctccatctctagctgcttgaatctagtctgcttagtgaaatcagattactcctaaaactaagtatgtgtcagatctcatccaacttgctcactgctccatcatatatctacaagctaactgttccaatatccttgatcgcacagcttaatttatctgacaaatgaatagtgatggcactactctctagggagttaaatagctctctctacaataaatatgatgcaaacatgctgaatctaaaatctactaagaaaaagaagtagatatcttatctaaaattagaagaacatcattatattcttcagtatcacaattttagaccactactgcagtagccttcatccgatccttgagctgtggataatctctgactcgatgccctaactgatcataccaatagcatttgatcttattgaagtctctcgacttggatctggaccgtctaccttgcgatcttctaccgcttcaacctctgccaccaccacctttagtcacttccaaagtcgagttgctatctgaatttgaagctcgattctctcatttgaagatcttattctaaaaaagtatagaagtgacctcatccatcttaatggtgctcttctccgtaagaagagcagtcaccaaagactcaaatgaagggagaagtgacgaaagcaagatgaacatcctgatcttctcctcaaccttctcaccaacactgaggagattagtgaggatcttctgtaagttgctgagatgctcctatatgctcagtccctcgctcatccacagctggtagaactgcttccaaaggaagaaaacattggtgagtcactttgctatatacatctcttcgagcttcatccacataaccattgaaaaagtctcaataagcacatggatcatcatattatttatcaagaataagtagatcgtactcaccacctgcatctagagctgcttcaaacttttatcctccatgatagtcgatttttcttcgcacaagagagtatcaatcaatccttattggatgagcacatccttcactctcgcttgctataggaagaaatgactcttcccatcataccgattgatctttatcttgattgagcatgtcttctctatcttctccaacctcaatcaacaccaccataatttggacagccacgtgctctgataccatttgtcggaaggaaccctcacaagtatggattatgaatctccacctaagatcgcaatgctgatgatgatgttgataccacaagaggaagaaagaagagagatataatcaaataatatagatcggctcaaggcttacctccatggggcattcaaacttcactatgagagaaataaatataataggagatcacaccctcttaactctcatacatcaatctctctctcaataagaagcacacaaaaaaactctcataaagctctcaactctcacaaaaagaccctatcagctactacccttgagactctctagccgctgcacataatacttagactgtttgcccccttttaaagccctcaagatcatgttggtaatgcatacacgagtcctatcaggattctaagtccaaactgtgtccagagccgcctatagaccaccgcagacccctctgcatgaactgaagccatggactaactcctttccatacaccacgtgctgcccaagcccccactcacgtgccctgcgacaaagaccatgcatcacccgatggaccgcatgaagaccgcacgtggaccgaatcaccatgcatcaaccatgactcccgccctcctagaccatgcggcggtccatgcatctcgtacatcttaggccatgcctatgggccgcacatgcctatgggccgcgcttgcaggcctacgtgcctgcgggtcatgctcctgtggttttgcactgtgggcttctccatcttgaacttatctactatgagttttactgctgtagatcgaatttgagataccaaaacccaatattgatatcatagagtgacatctataagttgatcgatccttagaatgaaaaagctatcctttggacaagccttattgagatcaatattgtcaatacaaattcgcaatttgcttctttaccattatgacattagcaattgactctgaagaatgggctttcgaataaatcccattgtcaggagtttgttaactttctcctcaattacttattgtcattctggggtgaagcttcttttcttttatcagacaagataatggttcaaatccatattcaacttatgaacaatgatatcgaaaggtacatctggcatgtctgatgctgatcaagcaaaaatattctcatgagtgcgtagtaatgccattgatcaatctctaaggttcggtgtcaattatgctccaagctaaatggttctgctcgaatcatcactgagtgaatttgcaacaagttgctcagttggttcacctcggacctctttcaactccttatggttttcaattgatagagcttccattggatgcttctcttttattatcaccaaaaaggattgacaagccagtatttgatcttctcatacttcaatgatcccattcctaatcgagaacctaacaagtaagtggtacatggagactatagctcgcaaggcatcaatctggattatccaaggatcgcattgtaagcagaggagactcgaataactaggaaagttagttgcacaatcttacttcaaggctcctgtctgacggtcatcgaaagagttatctcaccctctacagtcatggagtccctagagaatctaactagagaagtgttgacttttcttagtcgatcaatagacagtttcattctttgaaaactattgtaaaacaacacattaggtaagcttctattatcaattaatttttttttttacattatagtttgcaatcatcattgatatgatgatagcatcatcatgagtagtctgcaccccttacagttcattattagagaaagaaacaatatttccattcgctatctctttaccctctcaattgggccctctaccccctgccaccaacatagcatgaaattatatttataacactagccatgggttggttgatattatttttcttatcagattggtgttgctacgactcttcgggtgctcgatttcgtcactctcaagtatacttgttaagatagcatcttcagattaaggcctcaatatcatccttaagctagagatatttttcgatatatcatgatcatggtcatagtagaagcgacagtactttttcttgctcttcctctccagaaagtcctttatcggctcaggctattgaaaatatttctagccttcgatctctatcaggatctaggtccaaggagtggtcaaaggggtatagttgttgaactatcgaggaggacttctcgatcgatgattcttcgatggtcgggaggatttcttttctgctcaagtcgttcaaggatcctcctaacctcacttcttactgggagtctattttccttccgtttgcttccatgctgcttaggcttcttccatctgtatgtatttttagactcaggttagtaggtcagcataattttttgaaaaaaatttatcgagggagaagatgtggtactcattttgtaatcctcatttgagcactactatgctaccgacttgttgagattgcgcacctctagtgtggtagtattgaaacgtgcgatatagctacatagcgactcatcctcttcttactgatggagaagagactattggtagtttttagctgagctcgattactaccaaaatgagcaacgaacaaccttccaaactattcaaataattggatggactccaactggaatctcgaatatcatgtccgtattgactttttgaggatggtcgaggaggtaagacagaggaggatgtttgagatgccctatagcattatgagggtcctgtgatcctctaaatgattgaaggggtttgatgagccattataggctctacctaaggcattttgatccgactcaaaattggtttcctcagaatagcttgggagaaggggaaccaagagttgaaattgaggctgtcattattttagcaacaccactctagacctcgccaagccagagcttaatatcttggaccttctttttgatctcttcctctcatcgtgaccttctggatctgggagagtcgcctggtgtcgaatctccatcgaaggaagagagctatcgttggtcctcttccctcaagcttcgacgtgaggataatcgaggtgtaaaagtgggagcagagtagaggtgttgttgggaggtggattctgaacttttcaaatgaggtcgtcggttgtgtcaagatggagctacttgagtattcaactctggtcattgttattgctctgccacctattgaggccattgtacggcatagttagagtttggatctgacgaaccagggcatccaatggtagtgtattctgttgggaatagtgtttcaaagccaatcgtcagtctgttgacggttgtgctcattttttatatatgtacatgaattataaattaataaaaattattttagtatttttcatcataaaatatttcatcttctaatgaactcctatgttgtggtgaagtccttaggactatttagactcgacaaaggaggatttgtcatttagtccttaaatctgttcgcgatcaaatgatacgttgttaccaaggatgacaatatttatcaagcataggtcattgtgtaccatataggttggttgtcctcttaaccaatgagtgtggagacactgatatggcatacaggtgagatgtaagggtacatctgcactaaacgtgaccgactccagagctatttctgctgtcaaaatttgctctgatggaatatgggtataaatatccctccgatctgagaccgccacgatgacttgcaagcaactcactgtacttaggcactggactatctgaatttttaattcagtgatggaaggctgctgggtgcagtcaagtacttgacttgtcggtgcgtgtgtcaagatgggattgaccactctagtttaagagctgtgtacagtcatattttaatttagcaaaaccttggtcaggatagtctttgcgaggagtcacaggactgtttgagttgagcatgattcggatgatctaatcagggttgacagtttaaccctgagtcgtcctaaacacagaggtcaaaagatgaattatacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagaagcttcgtgtggacgatcagcagaggtcagacatgctgtgtagctatattatgatgatcagactctcctgacggtgatcagattgcggcgatctactacccgcacaaaggtattgtgttctgaacacattacaataaagtgtttactgttcaaattcgaatttcaaatttaaatgcatgcatgctatatatcatatttagattctaatgtaggataaatttttattaattaattagattaattaataattttcactgtaaaatagtgattttgaaaaagttttaaaattaccattttacccctgcactgattttccccacaaattcatcgtaataggaggccgtatagtggcagatccttgagcggtgttgctctagctatgatggaggattttcgatgagagatggtggaattatgtactctcgtctgtaccatgctctctttcctctttgaacatatttttatagccttttctttaatgcaaatttgttgcttcaagtcttcgatccgaggtagatgcggttgaggttggtgccaatttgaggccgacacatccaaagagaacctacaagagaagcccgtactcgctagaggatcccgataggggatcctctgatggttaagttaaccagagcttaacaacagtagagaaaatgagagagagagagagatgatattcttttatttgattaggtttatctcaggattctcttggcacttctttatataggggtggagtcataagttgttagtcagaatctgttaggtataatcttttagattgttaagctatattctgatagattgttaaggtagaaaatctttctactaatctgcaaatcaaaattgttaaatagttgtggattttgcccatgtgggtaaatgaactaatagtttgaggcataaaactgaggcaacggctatttctaagattctgagacatcgtcttccctctttaatagtggggctttattttccatctttcataagatccaactatagggctggtaagattctgaccataggctcagtcattatccgagctaaagatcgataggaggccaatgatagagaattggtccatcttgatttttcagctctcttcagggttcgagatagtcctgctgagccatcaattaagtacttggttgtgtttcgagagaaaagaaaggttgcttcatacggtagattgcctccgtaacaagtaggcagaggcccatgaaagacaagaagctgacgttggcagtgggggcggcgtccctccttctggggtaatgtcactggcatcttctccattatttatttatttatttatttttatttttatttttttgtgcgttagaaatcattgcattagtgagagtggtctcctgagatgaggaggttgcaggattctccatgacgtgaagtggaggtggtggagaagagaggaggatcaagattatgaagctacatgctctgataccatgaaatgttggggatgattgcagaccgtgcatgagaacctggtgattagccagcaactgaagataagagcacctagatacagaagcacaaacaatcaaaaacaagggcaatgccctagcttcgagaaaatgagagagaagaagagagttatttgggagaaagagcttttatttcttttttgtattcagcatacaataaatccttgacctagttatatgtatatatacctatacaaatagatcaagtccaaaactcaataaaactttcaaatagctaacccaatgtgatgcacttctcaagcccatgtacgctcatgtcttgccatgcactcactttttagacttaattctcgtccaaactatagattagctccttaagatcactctgaccaaagtcttaagtcatctaggatcaaactcgatcctagatccaaacagaatcccgaatagcttctatccaaaaactgagtcgactcatgctgagactgagtcggctcatctgaaactgagtcagttcaaactaaaactgagtcgactcacttgcatgttggcctcaagttctcgaaatcctactttttgtctgacttctcttttgagacatagtcgacccactctgagactagatcgactcaccttcaacttgattgatccagtctcaaaaatgagccaactaagcagtagaaatactctatcttgactggttcttctactggcttgcttccttgaccccttggcttcttctcttgagtttccaaggcttgggataacacacctgagctcacaatctccaccttgatgctcctaagcccttgtgaactcaactttattcttcagacctatccatgccacacatgtttgaaaactgtctcaagaaagtaccttcatgagtgtatctgactggttctcctttgtatggaccttcaccagctccacttcaccttcttccatcagctctttgattctgtggtacctcatgtctatatactttgtcctagcatgatagactaggttctatgccagctacagagtactctgactatcactgtacactgcaactgcgctctgttccatccccatttcagcaataagcctcttcaaccacaatgcttctttagaagcatctgtgatacctatgtactcaatctttgtggtagacaagactgtaatagattgaaggattgatcttcaagaaattggcccaccaaacatgcagaagaaataacctatggtagacctctttatatcaagattacctacaaagttagcatcaacaaacccttccaatggatctgagatctcccttaagatatttgagttcctcttaggtccatcttgctatccaaaaattagaccaaaccttcgagtttcctgaagataccgcaaaattcacttcaatgcctgccggtgctttttttttcgggtttgccatgtatctgctcacctggctcactgcatgtgttatatttggcctgcaacacaccatagcatacatcatgctgcccacagcactagcatataaaactctctccatatactctttctcttcctctatctgagggcactgctgctttgaaagagacatatagcttgtcaatggtgttccaaccagtttggccttcttcatcccaaacctctccaacaccttgctgatgtatcctccctgtgacaagtggagaatacccctgctcctatcccaacaaatctttatgccgagtatcttcctggtaagatccaaatccttcatctcaaattctacagacaatgcactttgcagctcattcactgcatctgcacttcttttggcattgagcatatcgtccacatgcagaagcaagtataatgcatcatcttcatctacatccttcacatatacgcaactatcatattcacatctagagaatccaagaatcaaaatgaaagtatcaaacctttcgtaccactgacagggtgactgcttcgagccatagaaagatttcttaagtaaacacatcttctccttcaatccagactgaatgaaatcatctggttgcttcatgtagatcctcacctttaggctcctatataagaatgccatcttcacatccatctgctccaactccatatcatgctaagctacaagcgacagcaacatccggattgaagcatgacgcactatcagaaagaataccttagtgtagtctacttcctctctctgagagtactctttggcaataaaccttgccttgaatctaactccatcttactctgaaggtgcctccttccatgtgaacacccacttagaaccaatagctcgagcacctcttggtagatccactagctgctatgtcttgatcttttccagtgactccatctcttctctcatggcctgtatccatgactcccgatctagactttccatggcctcctcaaacacctctggatctccattagtagtaatgagagcatatgaaattgtctcatcaataccatacctaagcgatctgtaaattatacgttggagcttgtgcaatgccactctcactagtgcattcctcccacctaatatctgtggctcctcctgcacctccatctgaatagctggctctccatgctgatcctccacttgagtaggacctcttctatctaactccaccttaattggtacactcctgtaggtggaagtagactacatgccttcagcctgtgattgagcaccactatccatctttacttttccagctcttcttgtactctccgatctctccaagatgctcttctcatcaaaaatgacatccctactgatcaccgacctctgtgcctgagaatcctacaatagataccctttgaatctctatggatacctgatgaatgtcatcttctgagactttgggtccaacttgcttcttttcagttgcctccacatgtgcataggctggataactaaaaaccctcaggtggccaagctccaccttcttttcactctagacctcctctggaatatctccattcagcttgcgataaagggacctgttaacaaaaaaatatgaaaaagctattgcagcaccccaaaaagactttgggagtgatgtctgtagcctcaaactccatgctttcttcatcagtgttcagttcatcctctctgcaacaccattctgttgagggatcatcttcactgtgtaatgatgtttgatactattctcctcacagtaccttttgaactctagacttgtgtattctcctccattatcagacctcaagcattttacttatcttcttatctctttttctacctcagctttctaggctctgaatcgggcaactacatctgatttttctctaatcagatatagccacatcttctttaagtagtcatcaataaatgtgatgaagaatcttgcctcacctctagctgataccggagctgatctccatacatctgagtgcaccaaatctagcactccttcactgtgcttggtacagttggcaaacttcaccctatgctgtttgctaaaaatgtatggctcacacaaatcattgccctccttcttcagggctgggattataccttatttgtttaactccatgagccctcggtcacttatgtgatccattcgatagtgtcatagtcgatacatcagctgctcctcctgtaccgctacaagcacttccctactatcattcaccactgagcttttcatctgatagagattattgctcggccttcttaccctcatcaccactaaaactcccttggtaatcttcaagcatccactccccagctgactactaaaagtatatccctgcttcttcaagtagtctaaagatatcaaattcttctttaactctggcacatacttgacattcgataatgtacgaatgaccccatcgtacatccttaccctaatagtgccaactttgaccaccttacaagggtgatcatcaccaaggctgacacctcctctatcgatctttatgtaagtagcaaactactcccgatgagatgtgtaatgatgtgagtatgctgaagtcaatgtccacataatatcacactctgtggatccatctgatacaaccagcagatcttcctcgctactcccagatgccgtatcatcatttttgctggcctttcccttctttgattttcaaagaggataattccttttcaagtgttcagtttgatgatacttgaaatattttcagacttttttctgatctcgagactttgatctatccttagattacccctgaccttctcctttggtcttccctgcctctcattcacagccaaaatctcagagttagaattttctttgcaaatctttttccgttgcttattagacttgagcactccaacaacctcttcatagtttaaggtctcatttctataaactaagattgttataagaccgtcatatgattctggaagagaacacagcaacaacaatgccctaatctcctcttctatcttcacatcgagactcatcatctctgaacagacttgattaaatctttgaatgtgagcaacaaggtctcctccttcggatgtcctcaaactgtacagctgtttcttcaaccatagcttatttgttatgttcttccccatatatgtattctccagtcttatccagagccctttgtagtagtctttgtatatacctcgggcaacacctgatcagccaagcacattcggatggtgctaaaagcaatttcttccaactccttccaatcctcagcattgatcctttccaatctctcccttatcaagaccgtgtagatcttttgctgaaccaccaaattctttaccctttgctgtcataggataaagtttttcttgccatcaaacttctcgaagtccaccttgaattcacttgaaactattaccacaatcaagcaaatctgcaatcctaacatccttctgcaatcacacaccaaaacaatcataataccttctctttcacttcttccacgtgcagaacctctccacctcaaccaagagatcactatgaagaagataaagaagagttttaggataaaacctgatgctgcagatcctggatgcaaaaaccctacacgccttctttctttcttccatgcaatcccactctgataccaattgctggggatgatcgtggactgtgcgtgggaacctagtgattcgccaataactaaagacaagagcacctaaatgtggaagcacaaacaatcaagaacaagggcaatgccctagcttcgagaaaacaagagagaagaagagagttctttgggagaaagagcttttatttcttttttgtattcagcatacaataaatccttgacctagttacatgtatatatacctatacaaaaaggttaagcccaaagctcaacaaaactttcaaatagctaacccaatgtgatgcactcttcaagcccatgtgcacctatgtcttgccatgcattcatcccttgaacttaattctagcccaaacaatggattagccccttaagacctctctgaccaaggccctagatccaaacagaatcctgaacagcatctgtccaaaaattgagtcgactcatgctaagactgagttgactcacctgagattgagttgactcacctacatgtcggcttcagatttttgaaatcctactttctgtctagcttctcttctaagatttagtcgatccattttgagactggatcaacttaccttcaacttagtcgatccagtctaaaaaatgagccgattaagcagaaacattctatcctgactgattcttctgttggttttctcctttgacctcttgatttcttctcatgtgttttcaaggcttgggagtgccacacctaaactcacataaaatgggtttaacttgagaaaggaaagagattttatttttttggatcatgttcatcctgtcgatgctattcacataatatagagatgatatggtgtttgttatctttagatacaatagacctgaataattataggatgaagttacaacaaaggagacctatctttaattaattattgttggtcagttgagtgccatctttattatcgagctggtgcttatcctcatcagtagtagtggacatgcatggtgggcggacgtgtgtgggcaatgagagtctgctatcaattctcactggggtactcacgagacatctctggagcttccatgcatctccgcttctcaagcaacacctcaccagcactcgttctagaaaattttcctagagacaatctacatcagccacttcatccgaatatatgatgacttgctgcacttacaattgttcacatagctcaagactgctttctccgatctcacacaccactgctcaaacgttctattaaacagcgtttgcatgccctcctctcattaatttgatcgctttctcatgatcacacacaccacggtcacacattctattgcacatcatgtgggtgttctattcttctttgttgcagcactagagctgtaaatgggtcaaattagaccgatatttcgattggattttaatattggatccagactcaatcttatagaaaagtagatcggatctacggccaagactttcgacctaatgagtcattcaattcgaatcggatccatatataatctagctctaatattaaaagttcaaatttggatcaaatcctgatcaaatatagctaattatattttagttaccataaagccaactattattaaccatgcaaaatagacaataaacaatgttgctctaaaaaaaaatatacaaataattttagaccaatctttttattaaaaatattgctcatactagtcttaaatcacagtttaaaggtttaaataggtttgaatcctaatggcatacctggtttgggtcgtgttggatccaaattcaataaatttaaaaaaatagaataaatctaattttagaatcgatctgaccctatagattctttaaaataaattgaattggatggattggatcagctaggatcctaagtcaatccaatccatttgcagccttacccacaaaccgttctatgccttcccgattagcgccctctgttcgctgcctgcaatctatgaatgccaccactcattgccgccactccaccgtaacataatcttgcactgttacagctaccttcacttctgcgggctactgaactacaaccagtatcatctgtgtcatcacagtctgggccatcgatccatagccagttttgccatggctccgcaccatgcaaccaccactccatccgtgcagcctctcaagttaaggcaccattctctagtctgtaactacctgagccattgaatcacaaccaccgtcgcaatgatatagggcacaccctcgacgaattattaggtatggttagtctaccacatcagctgtatgctagcccaataaaaactcaacatatgatactcctaactttgtctcctaaactactcttctaatcatggttacaaaaatttaaaaaaataattttgcttgaagctctatcattttgacgttgccagcagctgaagcccatctcctattcgtcttcgcatctcctcttcctcttcatctttttaccgtgaccctaatcttcttaatcttaattaaaactcaaatgaggaaaaaaaaaaaggttcactgacctatttcaagtacccacctcgtttatcaaaaaaaagtacccacctcccctggtgttgtcatcatcctggatccactcgatgaggtataccaatagaaagtcgacaacatcgaaggtctccaaagtttgaaggagagagaaattttttgtacaccgtaaacggtgtagaaatatgcatactgttcacgatgattgattcacccataaagccatagtgtaacgtataaaaaaaaaaaattatttcatcgatttcatgtgggaatcgatcatcacggatagtgtgtggggttctgcaccgctcctggtgcacaaaaatttcgcttggaggagaactagagttggtgtcatcggtgtcctaaatgatgggaccactatcaaagaaattattaagaaatgtcggctcctcagccacctttcgctccaaccgctgcatcactgtcccatcttcccaccccacccgccccctccggctctccaacgcccttcatgccatcacacgcgtcaagcccctcaacttcgataactcccacgcccttgatgcctttcatgccatcacccacattaagggctgctcgatcacccatgaattccatctcctcttctcctcaacccctcaccaccacaaggaaaatatgatcctatacagcataaaactgaaagccacccccagaaccaccccttgagaattggatcgactcatctatacatcaaagggtccaattttgcagaagggaaacttaaaactgaaacaaagaaaagtttggcctgcttgcagcaccaaccgcataccctcaaccatcccacccaaaatccaaaaaagaaaaaaaaaaatacaagactatccaacggcattagctagggaactaaatgaagagaattgaagggtctatcatcgccattatcatcttcatttccactctagattcaactctattcaaatcaagagatctagtagctctatttcttattacatgtctattcaatttttaagcaatatacagaacaatcatcaaggaatgctagtccgagaccgttcaaccccccaaacccctgcaccaacaaccacaacagtgagcatcgcggttccgacctccatccaaccaagaatttgaacctctccaccaggttctgagataatcactgcaagatcctcaatgtcttccttctcgtcgccaccattgatgccctcttcttcccaggtagcacaggtgacaccgccaccctcctcttgtttgaagagacctgcgccgccaccatcacccccttctgcattgtgtacgcccaaatctcctaaacttccatctcttcttctttcccagaattttctttaagattttggttggaggtgaagagagataggagatgcgaggatgaagcccaaaacacgaaaatgatggagcaaaattatttttgttattttcctaaccacggttgggagactagttttttttttttttttgatattacaaagaaaaaggctgtaactaattttaagagtactagcaaccatcttcaatcaccacaacattatactacctaactacaaatacacagcaaattaataccttcagagtcccacccccatcctgtctgcattcaacaaatattgaatatgagaggaactaggtgggatatgagttatagtaaaatcctcttctagagcttgtttgccagaaaatttgtaaccaaatatgcatccctgttaacataagaaatacggaaataagtccttgaggttttccatgcatgcatcaatatcctgtaacggagggatttggtactttttagtatgaagattgccaatccagttgataactgtaagagcatcgccttcaagccaaatcctatcaccctgaaggtagttcacaacataagaagtgcctagccaggcagcctagagttcagcagacactgaagtataccgaagtcttttgcctcttgctgccaccaattttcctatgcaatctctgatcatgaatctaccagccaccctcttcccattaactactgcaccaaaatttattttaacaacagaggagggggttgccccctcaaacaattagaagaaatagatgagttagaggctacaaatatagcaccccagggccttgatggagagttaaaacttgacacatcaaaaaatatagcaaaacattgcgtataaattcctcttaggagatctataggcctctgattgatttgttggaatactctttcattacgggccctccattgaccagccgcaatcgaagcaagaaaagctttgtgccaactctctaccataacaaacaccaccagaatattttgaccctcagaggcacattatgtctccaaacccatttaaactcaacattcatcatgaaggaggtgaaacaggacagtatcgtatacataccattgatactaatatggttaagattagaatatccccactatccctgatcaggccaagtaccataaagaaccgggatggtgctaatttgatgcatcatatcaaccggaaacatggaagatggcagttctatgttccaagtaggagtaaccggattctaaacgagcatatcattcatattttaatagataggccaagcacttaagaggcataagagaaaaccaaggctgcaaaaacacattgatagaagagccatctccaatagaccattaaaaaattaaactggatttttgatccaaaggcacagattttgttccagattgtagagcaactggagggatttttgtagttagaccaagaaccaatgaactggcacttggcacacacaactgaagcccataaggaactaggatgaagaatgatcttagcagcaagtttacagtgttgtctgccttcagagattgaatccccaatcccctatgatctttaggtagcccaaccgtttcctaggcaataagatgcaacccccttctatccgaaggatgaccccaaagggaggatttaaattgtttctccaaatcggtaataacaaatataggcaccggcacactatataaagagaataagggaactaagaacgatatagattgaagtagccctacgaggtaatgagagagttttctatttccaacttccgatttgggtagtcaccttatccaccaaaaaattaaaatctgttgatactagagttatacttggaatctgaatgccaagataagtccaaaccccctttttctctgatatcctccatatctttcgaatatgattttcaacagcacttgaaatggagcgactaaacttcaatttgtaacggttgataggttgccttgcaagcggacaatgtgcatcagtgatagctttcaatgctgtcacctctatgactgtagtcctggccactagaaggcaattgtcagcacaaaaaacatgggatgttgatgcgctccacgatatccgttcaagttctgtaataaattactttgaacaataatttttaagaaaatagataaggtatcaacatatcaaataaaaaaataaaaaggtaacgaaaatttttgacgagaccttctgatcggagttagctattgagaaaccattctattatggttaatcctctattacacccattgttgaagaacatttgtaaaaaaagttcatgctgatcgaaattatatccgacaaagattcttcgatgcttaagtcaacaaaaagtggtgaatagcagataaaattttcagagaggcagaatattagtccagaagtatcttaccaatactattgatttacctcctttttatagatgagttattggtaaccgtttgtaatggttagacatgtgggtttcacttattttgacattatgtaatcatggaatgaacggttatacccattattgatcatggtatgtggccattatgcgctttctgcactgacagtttttgatatactgactctacgttggtagtctgagtgtgtcgactgtatgtcggcaattgtagaaatccgaatgatcatcggtcggtaaatctgatttgtcgatggtcattgatcataaagtcggttaagtcaccatggttgaattgtatttgccagaaaagttgagaataaccgattattggtcggcctactgattgatagtcagtggtctatacctattaggccaaatgaaagtcagttgatgtgttgtaatggaggcggaactcgttttgggatatagctttgatggtttattgtctataaccgatagatatccgatcggccgactgtgatcggagaagcagactgaattatctcaacagttgctctccactcccaaatccaaagtggcccgacatgtagattggcatgtggcttgacacgttggacggatggagttgtcacgtgctatcttgagctctgatttaactgtaaacattaatgatttcttcgaaaaatgaagagtctccagccgttttgttgcttcgataaccatgagaccatcattgggatgtcgattcgagaagatgatttggcatctggagaatccgatcaatttgattctgactagttgatttcggccacgtatccggatgtcattggctctaaaccgttcacatagatagaggtgaggtgtcatgatctggcggtaggtgcgtcaaaccatccgatcgatggttgattttgatgcagccacatgtcgaaatctggagcagtcttgatttgaataatttcatcacgaccattgatgggccatatatatatataatatcactttcatttgaattttttatttttgtatttgtcatcttctcctgcaattgaggatttcgtcttggatgctgagagcttcaacatttttgaagtcctctttgtatttccacggtcttccaaatcatcccctagttccggggcatgttttttttctttcttttcttcttcttctaggtttcttttcctactattttcaatggctagtaagagcaggaaagataaagggaagattagaatagatgaggttcctcgagatagtcaatcgaaaaacccgattgacgattctctttcggatccggatatgaaagtttcttccttatctggatcccatgttgatcagcttcgaaaacatgcaatatcatatcccggagcaatttcaactttttgcatctgatctggatggtcggataagttctcctcctctgagtcaaatagcaatttatgtagaggaccttcaggctggtcttcattttttgattccgaagtttatccaaaatctccttgattattattctctgtcctactcagttggctccaaattctatttggttaatcattagttttgctttgttatatcgcttgatctcgaccaaccctcgatcttcacttttccgtgcttttttcattcttcgtctccatccaaaaaccaagggttggtggttcttcaacttaagaaaggatttatcttttatttttggtcttcctttgtccattcacgggtggaagaaccaatttttttttattttttcttcttcatcctaggacttttcttgtcttgtagagatccgagaataaatcccaacgaacatagtcggatcgatgttatcaatcgagagaacttttttcgactgaaagatatggaagtctccacataacaagagctactgatggagcaatctctctataacgctggacttagtctgatgacttctctaggtatagctgagtcggtcattcactttattttcatttatctttgaactttgtaactgaatctttttactttctgattacagctatgcgaccaatggtgcgaatctcgatggtcgatgtttgccaacatgttgctaagaagaaagcagtgatcgatgctggaccatcccgaataatgaagaagagtcgggttgttcggagtcgacatcgatgtaggagatcgacattccatcgatagtgatttccgatgctgagtcagttatcacactgtcagctccaacagtgcttcctccaatcgatgtaccatcgatcaaagtgaaattaaccagagatggtgatgtcgtggccatcatactggtagcggccaagatgacgccaatcatgttttcatcggcaggaggtcaagtcgagtctgctattgcggtcgaaccagaactatctgtcactgtactgactatacctcaagcaccttcaactgggccgatgctgtttcaagtgccattaacttctgacttcatgacagcttcgagcgaacgaccatcaactggagagcgagaaaaggcgccagctgtttctgtcgatgatggatcatcaacaagcttcaccgtgctttttgacatctggattcctacaagtgagtcagttttggccaatccaaaattggacaagcggctcatcgaggctacacttctctcgattgataaggagaatagaaaagatcagaccgtgtttgagatatttttgtcttcctacccaatgatactcgacgtaagttgatgatacttttctgatactcttctattttttgtttttgttttcaatctaacttgttttcttttcttttcagctagcacatgatatgtatgcattggagagtgagcatcgaaaaattatcgagtttcattgagcatggatggataaaactacagctacaaacatcgagaaggctactgctgttgaacccctctaggtgacaaccgaatgggagaaggcagtagttgagtgggagaaagagcttcaagagaaaatctcccatgctaaggtcaagttggagtcgaccagagccgaattagagtcagctcaatagaacattaagtccctgaagtctcgaaccaagaacaaaaagcactcaatcaaacggcttcgaagggagtgtgatggctgcatcgaggagctggagaatgaacggagaaggcatcaggccactgaggagagattggcactaaccgatgtagagtcggctttcgttgaggaagcacagtcggtgaaagatgctctcagtcgggctgtcgaggattacaaagaatcatcaaacttcaaaaataaaatcctcaagggcggctacttctcttactacgtcggttatgaagacggtaaggatgcagtcaaaaagctatatccaaattgggactttagcagcatcgttgcccttggttcggggaagagattgccgaggagattgcaccaactgaagaagttacaccagctgcaccagaatctgcttccattattgacaaagctgtaccagagtcaactattgccaaaggccatgaaatcggagctacgatggttatcgacatagctgaggaagaaactgactggcgatcggtgtagatatttttttttctttcttgtaatcggacaatagtccaacttttttttgtaatcagaccttgggtccgattttgtaatctttttttcaatgaatgaaaagataatttttttttctaaatatggagttccttttcagtcttgatgcacattgttgttgatgttattgaatatcagtcagattgctaattatcaatcggtgtgttgaatgtcgatcagtagtcatagtagaataatttgtctgctagtcggatatcacctgacttagattttaaataattttttttaaaatatttgatagacggtggcaagtcgaatattcttcgctgatcggagtgaagtcggtatacttcctactcgattggagcgagtcggcataatattccattctgccatagctgagtggcatattattctacttagccaaagccaagtcggcatgagtggtcattcgacttgagtcagtttctacagtggttcgatcgagatgtggttgatataaattgatcgatcatttatcgatctgatgtcatttttgtagataactgaatattctgagaatctcaatattttatttcaaatatgttgtatatataaacaactttactgatagtatattttcaaactatcgacatttcaactctgaggaatagtcattccattaagagtttctagtcgatacatatctagacaaagtatttcgatcaccttataaggtctttctcaatttagagattttttttttgatctaaagattttgaaacttctgtctttcttaagactaggtctcttggacggaagaccttcagcttgatctttgcattatagtatcaggccactctttgccaatatgctgccatccgaatttgagcttgctgtcgaacttcttggagtaagtctaggtcagcttttcaacattcaaaattacttggctcattatattggtcgactctcactgacagcaatccaatctcgagcaagattattacttctattccataggtcaaattaaatggcaattctcctattggtatatgtagagttgtccgatatacttagaagatcggatataatttttctatccagaggcttttagtttcattcaatctggccttaagaccatgtagaattattcgatttgtcactttcacttcatcgttagattatggatgaccgacataagtgagtttgtacgtaatgtgaagtttcacacaaaactttttgaagttttgactatcaaattatcgatcattatcggtgatgatggtgtgtggtaaatcgaatctacatatgattgatttctggataaagtctttcatcttattttcagtgatttgtgtcaaaggttcggcttccatccatttggtgaagtaatctacggcaaccactataaattttttctaaccagacatcgagaaaaatgaatcaagtatgtcgattctctattatacgaagggtcatggtgcaataattgatgtcagctgactggtcggttgatgttgtatgttggcatacttctgacatgatttatattttccaaaaaatttagctgcatctttctttatggtgggccaataatatccttatcgcaaaactttataagccaatgatttatcctcctaagtaatttccacaaattccttcgtaaacttttcggagtgcatagtcggcgtctataggtttcaagcactttagtaagggaagagagaatgaccttttataaagttattcattcatcaaaatatattatgaggccgtccaccttagtcgtttgatctctgaaagatctgtaggtaaagtttcatcagtcaagtattggatgatcggatccatccaacttggttcatcattaatttgtagcattttatcaattttatcaatactcgattgttcaagatatttaatgaacgtacggtcgaacgagctgaatgaggaagttgcgagtcgaaaaaatgcattagcttgagcattctctattttcgagatgtgagagatctcgaagtatttcaaggctgatgtaagatcttttactttctgaagatacatcataatagaatttcgggctccaaattcattcttgacctgtccgatgatcaattgtgagtcggtaaagactttcaaactatttatatcaagttctttagtaattttcaagctagctaaaagagtttcatacctagcttggttatttaagactttaaaattaaactcaagagcatactcagtcatgatccctttagaattagtaaggatgaagccgaccctactatcttgatcattggatactccatcaatatgtaacacccatatggataataagttggcatcgaaagtttcaatttattttgatttgccgtcaaatttatcctcaagattatcattggatacggtgcattcggtgataaaatcgatcaaaacttatgctttcattgatgatcatgggcgatattaaatatcaaacttactgagtttaattatccactttgccatccgaccagaggtattaagctaatataaaattgctctcaatggtcgatctgttaagacaactattggatgtgcctaaaagtatggtcgaagtcattgtgccgatatgatcagagcacagatcatcttatccactctcgaggattatactttgatattgtggagtactttgctagtataataaattgatcattgaattcgattttcatcctcctggatgagtaccgaactgactgtctttgccaagatcgtcaaatagagatataatgtttctcccaccttcaattttgtgagtaatgatggagatgctagatatttttttaaatcttcgaaagattgtcggtagtcatctgaccatgaaaaatctttcatttgtcacaaagtcttgaagaaggatagatacctttctatcgatcttgaaatgaatcgattgagtgcggcaatccttccattgagttgctgtatctctttctttgagctcagatgcttcatattaataatagtctttatttttttaggattagctacaatttttcattgtgatacaaaaaatttaaaaaaaaaattgactgtcactccaaatacacacttagtcagattcaattttatctggtatcgtcaaagtatatcgaaggtttcttctaagtctcaaatataatttgaagtttcaaaattttttaccaacatatcatcaatgtagacctttatgttacatttgatttgtgtcttgaacagtctgttgactagccgttgataagttgctccaatgacatcactttatagcagtagatgccattgtcggttataaaggcagtatgcttctcatcttcaggtgtcattcgaatttagttgtagcccgcgaaggcatctataaaacttaagagttgatgtcccgaagttgcatcaattagttgatcgatttttgataaagaaaagatgtttttcagacaaacttcatttaaattggtatagttgatgcagattttttatttttcattgatctttttcaccattactatattagcaagctaatctggatagttagcttctcttatgaagtcagtttcgaggagcttgtcaacttcttcatcgatgatcttctatctttcaggagcaaaagatcttttcttctatctcactagtctaactttgggatcaatattcaattaatgagttgttactttcgaaaaaattttaggcatatcgattgtcgatcaagtaaaaatgttggcatttgctcttagtaggttcactagttattttcactctggatcagataattgagatccaacttggaccatctttaagggatcatcttctcttaatgggatcgaaactagttgtttggctggttcactcatttcttcattttttttttgatccagtttatcaaccgacaaagaatcttcagattgattgttctttacagagatcataaagcagcatcggatcagttgttaatctccacacatttctccaacttaattttttatcgagaatcggatcaataaatggtatgttgatactattgctctcaagacattaagtcctgatcatccaagtatgacattgtaagctgaaagaactcggacgatcgtaaacgttaagagaatgatactttattatagatctattcttgtagttagtggaagagtattttttttttcacgatgactgcatctccagtaaaatcgactaatgacgtcgagatttttttgagtcggtcaattggtagttacattcgagagaaaatcgagtaaaacagaacatcattgaaacttttattatcaaccaagattttttttacatcataatttactatcatcatcgagatgacaacagcatcatcatggagagtctatattctccgaacatcatctttcgaaaaagagattatattgttgtcaagtcgttgcttctttatcaactcttctttgaaagttgccccctgatcctttgattgcctagaaatcatgttgataactttcgtcgttggctgattgttgatcgttttctcaggttgtggttgaggttgtcggtcagtgggaagttgaatcaggcagtcttgttagaattttttgaggtagccatgtcaaatcaggacctttattttatccctaagctgaatacattattcagtatcgtgaccgtgatcatgataaaaccgacaatacttttttttgtcgcagctcctcggtggtgctttcatcgatgggggatgatggaggtattcctctccctcaatctctattaggatctacacatgaagagcaaaaagaaaaatataggagtcatacctgctatcataattgttcgatcttggactccatcgatggagtgaagctcttttgttggttgttgatcgatttggttcgatcggagcttcatcttttttttgcttctttttttgatatttttttttgcttgacgttggtcagaagtatcctcattcatgtgaatatacttgtatgcacgctctagaagttcaacataaattcaagagagagttttatctagagaataaataaatctggatcccttcatacttcttttcagggccgagatggccatatcttcattaagatctttgatctcaggcatggtcacgttaaagtgagccacaaagtctcttagtatctatgtctcaccttgcttaatggagaagagactatctgatgttcgcagcatctttcgactgatgctgaagtggaccacgaacaaatgtttgagctgctcaaaaaaatttatgctccccggttggagcccagaataccagactcgagcagtctttcgaatagtagctgagaagctaatgcataggagagcatcgatcatcctctgaatcatcatgagagccttgtaactctccagatagtcaatcggattgatggagccatcatatggctctatctgcagcatcttgaattagaatgggatcggctcgttcaagatatactaagaaagaggttaagcatgtggaagccgaggtcgttggaggacttccagccttccacttggagtcggaggagttgacaatcgatctttttaaatttgtgctcgtaatcatcgagccgttgttgctggaaaaattcaggggcagtcacctgaagaacttaaggattgagaagtggaaggtgcacacggcctctttcccttcttgatgatatgtccacgagaaggagaaggagatcatcacgaatggtggatagcatggtaagaatgttgagaaagtggtggctcgatatgatgagaatgttgagacggttgtcattctggggatggagaaagagatcatcgtggaagacggcaactgtgcttggatggcattgaatgcaccgtcgacccctctgccagcggttactgctattgctgcatttattattgttggagactgtgtactatctctgtcaatacttttatttgctgtattaaagtagtaatttgaacgtctgcagtgactacaggatgtgaagaactaggctctgccattagagatagaagagggaggtcttcccggtgtgaagattgtcttgcggatcctatggagttattttgagctctagtttttaccataattttttgtaagccctccttcctggcgtgccaatctactgcagccaatcctttgttacacccattgtcagagaagaacacctgcaaaagaagtccacactaactgaaattatgtccgacaaagatctttcgatgcttaagttagtgaagagtagtgaacagcagataaaattttcaaagagagagtattagcctagaagtatcttaccaatactgttcatttacctcctttttatagataagttgttggtaaccatttgtaacggttaggcatgtggattctacttattttgacaatatgtgatcatggaatggacagttatactcactattgatcatggtatgtagccattatgtgctttctgtgccgatgatttttgatataccgactctacatcggtagctgagtgtgtcgactgtatatcagtaattataaaaatttgaatgactatcgatcaataactctgatataccgatggtcattgatcatgaagtcggttaagtcaccatggtttaattgtatttgccaggaaagttgagaatagctgactgttgatcggcttactgattgatagtcggtggtctgtgcctatcaagtcgattgaaaatcagatgatgtgttgtaattgaggtggaactcattctgagatgtagctttgatggtttatcatcaataatcgatagatatccgatcgaccgactgtgaattaaaaaagtagactgaattatcccaacacatcccattacatagaatagcaaattcagagttaattagaaagctcgatcccactgcatgaacttggaatgaaaacaaaattgtgtcataacaataaataaaaaaagccagtgaatcttgtcataggcctcctccatatatatctaatttcattaccattactagtttagaaagaggtactttgtgcagtgaatgcaatatttcataggcaaaaaaggatattctccataatgttttggccttgaacgaagactccttgttcaattgaaatgatagtcggcaccacgaatttgagtgttctcataaggactttttaatgacaatcttataaggagaattgcacaagccaattggtctataatctgtagctctttgggggttattatttttaggaataagaacaatagatgtttgtttccaagaagggagataagcatgctagaataggtcttgaatggctgagatgatttcatgcctaatgattcgctaaaattcttcataaaagaatactatagaacccattgggaccaggggctttttaggatgcttttcagcaagggttttctttatctcagattccgtaatgagtttaataagatctatattctgtttattagtaataacctaactagttagaggagtatcaataggcataatacccccatcctcaagccactaactttgaaaatgtcgcataaggacttgctggattaggtgttgatcttccaccttttctccatcctcattttttatagaatgaattttattagtccttcttctgataatggtagatctatggaaatattgagcattagcatccccttctcgtagctaagtgattttggatttttgtctttagaaagtctcttgttgtttaagggttttatgatatgcacgaagaaatgctaataggtgcaaatgctggtgatttgggaggccttcttgatttgctcccaaaacatgtagagcattgattttctcatggaagttttgttcttctctaaatatgttacctattatatgcttccaatgcataataactatacgggtactctgcagcataagggacaccttgacccccagaaagtgaggctcatgacagtgctaggcctgttgtatcagcctcctaataccttcgtaattaagccatattttttcaaatctaaaaggaatattgcccctagtcctttgatttgacaaagagagcaaaagagaacaaggatccaaagcgaatctagttagatggcccatagtggcttaagggaatagatccatccattgattggagggaaaacctccatcgatgcattcctaaacatgagccaaaccctacctattgttccaccaagtataattaggccctcaatagcctacattaatcaagtctctcagatgccccttctgttgggaatagtgtcccaaagccaattgttagcctgttgacagttgtgctccttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctatgtacagtcgtgtttcaatttatcaaaatcttggccagggtagtcctagtgaagagtcataggactaattgagttgagcacgattcggatgatctcatcagggttgacagtttaaccctgagtcttcctaaacacaggggtcaaaaggaatgaattatacggtaaccatattcacgtagattctgaatgttgcgattgcgactattcgatctatccgatcgtcgggtaccattgctagatggtcacttcgattagtacagaaattggttcctgtgctaccggcttaggttcgaacctgcggggtcacacacattagaggttcctttctgatctgatggctgattttgagtcttatgtatctgggactctatgattgagaattaagattctttgatcatgagttccacacattttggatactggggtcaaaattttgaatttcaaattttgaatttgaaatttgaactctttgatcagggtttcatatcgatggtctctgatgcctaatagcccatcggatttggattcaatatttatgagaggtttaattagtgatttgatcgctaattaactcaatttgattgagtaattatttttaaatgaagtccaattgaattggattcagtttggattgacctgattaggttaagtgttgatctaatcgctaaggtggcttagtccctgatttaatcagggattaagtttagttaatttttatttgttaaatttattgagcctnnnnnnnnnnnnnnnnnnnnctcttatgatgttttataaaatgagaaagggagggggcgtgggcaatgaaagaaataagaaataaggggcgtggggaggttctagaaaaattttgaagtgttcaaaatttaccgagaggagagaaaaggagagagaagtgggcgcagggtttttggtgtgtaccctagggtttctacttagggttcaggaagtgagattggtatgccacgagtgtcgtgagtccaccaaatttcagggagagatccatcagcctctcaaccaaccatgcagatgatccaaagcatccgaggagtcaggacatatcgatcgaaggagttcgatcaacatcagccatcaaaaggatgaaatcacgaactagcattcgtgaggagccgatcagacaggagctttgtgtggatgatccgcagaggccagacactagtgtggctgtgacgtgacgatcagagccccctgatagtgatcagattgcggtgatcgactacccgcaaaaggtgatgtgttctgaacacagtacagtaaaaagtttactgtttcaaatttgaatttcaaatttaaatgcatgctgttgtatcatatttagatcctagtgtagggttaattagtattaataatgagattaattaataattttactataaaataataattatgaaaaagttttaaaaattatcattttgcccctgcaatgaattttcgcttcaccttcaaccttaaaagatttatctctatttttatctccaacttggagtgtacaattgaaatctccaatgaggagactatactggcccaaagatagagaactgctttcgaagttttttacatttggcttgcatacaccacctcaagaatccaaggagccccattcacttgcgtgatgagagcaatggctacttaattttctgtgtgagcaatatttttgcaccgggcaataactataccactaagaagaccaacaatcgggatcatatgaattttcttgattgtacctataaacctctagatcctaagcagccaattactagatagtctaggttttaagaaataaacaacaaccaagctatgttgcctgattagagttttagcatagttgatagaaagggacttgacagcaccctagcaattccacacaataatcttcatagggataaagattaagttacacatggcatccctatagtcccttgaccattggtgtcagcttggtcctattaggaaatgttaagatgcacagcagaaaaataataataacttttcgattaagcatgtgagatctcatttcaaaataacatgaaaaatctaggtttctcataatttttaagattaagattaacaaaaaaaaaataagatcaaaatcatcatcattgcactaatagatattcaccgtgatctaataattatggatatcttcacgatccttttgaagctatacaagcacccaacttctataggtatccacacaaggttctgatttgatcaatgtctctgatctcattggggtgctagctctcttgtagagatccctcttatgatgatagatttttttttcttatttcttattattgaaaattcttttctagaattttaaatttcttctttttatgagattgcatgccgtgcctttttctcttattccttattgctcaaagtccttctcaaggattttaccttttctccacaccatgagattacacaccgcaatcttttctcttattctttagtgctgaaaatccttctcaaggatttcagcttttctcctcattgtgagattgcatgctgcacccctttagtgcgagaaaactcctccttttgtaacataaatttttttacatgagaatcttgagcatgaacagttaaatcttaagcatgaaggactcttgggcatcaacacttttagtatgtccaactcttaggcacatgagatgtgaggagataaatggagtgtcaagtctctttcacatgaaaaacttggggcatggactctcttgtatgctaaatctcatatagagagtgagaagtccttttgaacatcaaatactttgatgcatgtcaaatatttattaatggatcaatctttgattgatcaaaagactgttaggagtccaagtgctttgaggtttgatggcatcaactctttgatacgtccaacctttgacatatcaatcttttgatcaatcgagtcctatagtgattcaaaaagcacaatctaaccatcgatccgtcacaacctgttatgtgtgtgatctcataaattttattctatctgataatgagataaattatgatctttatccacaatatcattgaaatttttttcaatgaatagaaacaattctaactcatcctaataagaattatcgactatcaagataattctcgatcgtgaaagaaatgtcatctgatggtgattcttatgcatgctaattttcaaattttttatttatgtatatagcagaaaataattttagatttaaataatttaaatctaattagatctaatttaataagtatgcatagagatcatatcttatatctaagaatcattatataaacaacatttagatctgtcctattaaaatctataattttacttttgcacggatagatcttcatcgcaatctgaaaaatcatagatgtctctcgagattttttagagccgcacaagcgtccagcctctatatgtatccacacaaggctgatctcgatcagaagactccaaagatcaccaatgtgctagctttcttacagatctttcttccttcaaatcaaatctaatttcttcttcttttcttctcaagaaagagaaagaggatgataaactaagagatggaagagggtttctcttttgggcagcaacaagaaagaagaagtccttctatatgggtggcaaggaaaaagagagtggggcggcaaagagagaggctagatagatttcatcaattgcttagggcatcctctctaaggggtcctatttaattatagacctcaaattcttatccttccatgagataaatttgaatcaaattcagataacaaagatttgaatcaaattcaaatcttaaatcctatttggataaggaaataaggaggagagggaggaaagagaagcctagagggggtgcaccaacaccttggctgcgtcttctctctccctcttttcattacacgcatgccccatgaaggggggccatcggcccttgcttccatgtgattggcgctcctctttaggtgatgtctaagaagtgagagagtcccaatccaactgggaactcctctcttaatgcttttaaattggttctgaatcaattcagataaggtgaagccaaatcctatttggattaggaatagccccaagttgaatcaaattaaatataatttaatttattcaaagtccaatcattaattaaatgatcaaatcaaatgattaatgattaattcaataacaattgcttaatattcttccttgtaactcactaaccctttagtaagtccttttttgtaactttaacaaattggtctagtcatcaatcaaattgataactaagttcatctatgaatcaaatttataattagattatttaatcaagtcaaaatcttttttgtgtgtgatcccatagattttattctatctgatagtgagtcatatgatgatctccatcataaatatcattgaaatccatttcaatagattgaaacacttccaactcatcttatgcgaattattgactatcaattaattctcgtatgtctcacaatccatcagtgatacctaataacatatagtggcaacccaaaagaatgaaagagtctgaacctcttggtgtgttaacgtgtgattcagttcttttatcatgagttctgataagatggagatcatgaaaaactcgtcaaacctcatcatatatcatatataagatttaatcagctcaagttcaactcgtgatttttcataaaaatttctttccatcaatcacatcaccatggccatggtcttaagaactcagcttcataactcacataggactactccttaacttctaaaatcgatagatttcatctaggtgcacattctattcctacagcaaacctgttagatatgtgtcctaaaaactaattttgactgacacatatctttctctaggatatattctatacttgatgggcagtctttataaccaatcatgtcatttgtatccatgatttgtcttaaaaattaacaaagataattttgtatattctcaagatgttgagaatttgagacgtacatcattagtagttaatttttaaatgctttcgattgaaggatcgtcacgaaggatggtgatcaatccattcaaaattggtgcacagatcacctctctttggggcagataagtctcgagtctatggtgtagagatactaaggtgagagtgcagatggttgttagagaataacttacactgagcgtgatcaatacaaaaaattacttggatgtctactcactcatcagtgatcttctcgatactgtagtgatgtgactggtcctttgacctgtagtgtattggctattcacagtgaggctacttagtttgactgcacattctcttagtctctagccattcaggttcttattatatatgttggctattgtaggttcagattcgttatttgaagtaggatgcacctagatgaaatctatcaatcttggtagaaaagaaaaaattctatacgatttataagattgagttcagaaaatctctggccagactaagtgtgaatactgaaaaagagttttcataagatttacaaatgaactcaagtcaaatcaatctagcatatgactgatgatagaatttgacgagttctccatgacctccgtcaagtcgaaactcataatagagaaattgtatcatatgataactacacctaagggttcatttttttattctactagattatcatcacatgttactaggcataactggtagattgtgagaactcactaagattatttttggatcaatgatctttgttgaggtgagttagaatcatttcaacccatctaaaagagttccgatgatactgtgatagagatcacggtatatctcactaccagacagaatagaatctgaggggtcacacacaaaaagagtatgacctgatcaatggcttagattatattcgaattatcaatcagattaatagtttaaattttaaaaattgctaatttgtaattgttataattttggtagctgctaattgttagcacagtgacttaattataaatattataatttttttgagactgcttaaattataaattaaattttaattaatttaaattaaattaaattaaattatatttaatttaatttaatttaatattaattggattcaattatccaaattagatttggatttcaagctcgattgaatcaggcttgacagctttttgaattcgacttgattcggactcaatttgaatccgattaagacccaacttgaacaagaagaatcatgactcaaagagcccagattctctgagactcttactttagaaatcatgccaagaagggaagaggggtgatgtttttctcatgcttctcttcttgcgtgcgcaaaggggagggggcgccaatagttagcgccccaccatatttgggtttctttttctttcaatttttttttatttgaatatgattcaaagtaggataaaaatatatctaattgaagtgtggaaattttttttgtgtcataaaaaaattgaagaaagagggcgtgcactaattatgagtggaggtttctttcttacatcacaattttatctcaacacttttctaccctttgatttggttttcaatgccctagattaaaagagattagatctcttagaaattaagaagggtttggggcatgagggatttgtggtgtgcgataaaaataaaaagagaggtgtgaggtcttgcgtgaacaagaagtgcgacttttttaggacatcacaatccttcctacgcctcctcctcccttctccccttcatctccatgccaagatctgatggtgatcagatctaagaagaggaaaacagagagaaaaagagaagaataagaaattttcttctcttcatggtgatctggttcagatcccatcgaatctgcgtgaaagagttcgcacagtgatcttcttcttcaagatctagaagaagagatctagatccaaagttgaggagcgagatctataaagtgctagcacatcgatgatctcgatgctccgatcagatatcttcgtgtggataccagcagagactagacgtgtgtgcagctacgattagaattcggatatccgcatatccaaggtatagagatccgatcttcgattgtttttgctaaccatttgtttttctttttagatttcagatcgtggttacatgttcgtatcaagatctttgctacaatttttagatcaaatctgatatataaataaattaaaaatattttaatttatttatttttactacttagatgtttaaaaaaaatttaaactatacgtacaaaattatagcgattttctaacagtagtatcagagcaagattctgatatgaacataaaaatctctcaaatctaaaatctaatttgtaaaaattagatctgaaggttagtttgatgatctactcattctgaaataagggtgttctgacataatcctgttatgctaaatgattatcctaaaatgatgtagaacatcgattaaggtcagatttgaattttctacatattgtaatatgattatcgaattattttagatataaaattatttcagatctgaaataaatcatgagtttttcagatctaaaattagttttagatttgaatatatcaattagagtttaatttagatctagtatgattgctgaaatttttcttatatgcatagaattaaaattattattcatatatttgacatgtgaaagataattagatctaatttttaattaattatatatgtgatatattagattaaatttttagtagcttagtaatcgaattgggatagtcactatagccgtccgatcataagatgatgaagggattaaagttcctttcttgcccattcgatgggttctctcttatgacgtgtaggggtatcgactgtgatatttttcatgaagatgaacagcaaataaaaaactatatatgatataaattttagatttaaatcagattatatatatatatttatatattttagatcattaaaatattatatttgatatattattttgacatacgatctaaaacttaatttctgtaaaattttagatccaaaatcctaggttctgtttgcatgaacatatgaaactgtgactagtatgcttgtagagttgactcaattcttaattgggtcgactcgagtgcttggtgagttaactcatttttgttggagtcaactcaagaccctggtaggtcagctcacttactgatgagccaactcaattgtgcaggttaggtcacaggtttctatttatctcagtgtatgccgactcactatgataagtcaattcatgtaccagagtgagtcgactcgattctacaaataacgatattatatgagataacaatataaattatttagatcagaaattatttcgagatctaaacttaaacccatgtacataatgcagttaattgagaattaatatttgaaattataaaatctaaaattatgaatttaagatctaaattttaatacataaaatatgagtttcaggtatgggttgaacaaattaagtttagagactaaattacaactaggatcattgattagatcaggttagaatcctttcgattttgagcaattgatcgaacctaatcaatagttgattgggattaggtcaaaagggctcaaaatagaatttagttgtagttggtcaaattgattcacatttgatgtgaattgattaagtcaagacctaatttgacttagcgattcaagtctggatctataagttaacctaattaattctaatcaaccaatttggtatctaagacaagtactagatagtgattatttaattgattctattgtctgacctgatcaattcattggtgtttaagaaaagcaacggagaaaccttactcatctttatttgtctgatcattttgaaagattatattttgtattaggttacttgtagatccgagttcacccatgccaactaggttggtcagatatgaaatatactgacccaaactatattagtcattatatcagatgtatgtgactaattagaagagacctaaactcaaatcttctcactaaatatttagttattggtcttccaccattgtagagatgtgggtgtctttttcgacgttgatcgttctcgactagttacagtggttcgattgtatcgacaaggtacaatcactttattggcattagatgacttgggctaaagatggtgttgggcccaataactgttaggtgagggacccaatgacggctttacacttgctggtgaatgatgggttggacttaactaagaaatatgccaataactgttaggtgagaccacaggacttagagatccagtcgctgcaacatgcttggagaagcatctggataaagagttgtccacatattgatatacgtgttatcaataactgttaggtgaggtgccgtatatcgataggaccacaacatccactagaactacttatcgtgttaggattttcttctccatccgagtgtgagagactcgaaaaattagtgagagcctttgtttgtttttaaagtccttagatcaaattattacaagtacaatcatctaattaaatctttactctctatgatcaattttttagcttccaacactcaagctcgaatcctagatattaaccatttagtcaaaattaaattacatattctggcttaaaaatctaagaatagttcttagcttttagaaattaaatcatgattcttgatcaggttaaaccaatgtcatcagtttgtccaatccatgatcaacaagctatacttgacaaatagttggacattgacaattagattaggtgctataaattaaacttcatagttgatgaaatctaatgtatgcataaggacatgtagactatcaatgatatattaattcatctgcaatagttgtaagatgatcagagtcgcacagtgcatgagatgcatgatggatattttatccatgatcgatgatcaaggatattgaagagcttgagaagctcgacatgaccatgcataagatattactaatgaatttgatcctgtgatctttaattcatatggatagtttgtgaaactattatatgaataaatattataacatcttaattgaattggtcgatatgctggtaactaagggatcttgaaaagttcgaaggtacatacctggagaacctaaagaaatattgacacgcttttggaaagtatgtcaaattactcaaaattgatattacaatttttttctttttcattagactctagtacatattacgtattctaatataagatctaaggaagaaagaggactgaaggaaggtggagtgacttttttgagtcggtaatgatgcaaatattgcactgagaccgtgagtacctaatctcagtgattatcatttggatttaattctttatcatttgcatgataatgcatttgtgaaaattatgtgagcaaatagtgaatgccattggatctgaaagatccaaaaccaaataatctaaagtatatagatggttcctttggctaagtcatgtatgagaagaaatgatttgccgaccgaagaaaatgggctttttgggctcattgactgttaagtcatatctagtctacaaatcatctctttgaggattaatgactaaactgtcctttatgggttaaagagataagaccactgagatacttatcttagtacacatacaatatgcatggcctatttgatgaactagactaggaggttatcactactttatcatctttaccgatgaacagtcatggtataagtatgtatgtaaaatacaaatctgaaagattttgaaaggttcaaagaatttaggtgtaaagtaaaaaagataaatggaaaagtttctaaagatactttgatcagatcgaggatgcaataccaaatggagaatttatcggttatctaaaagaatggcatagtttcatgatggaattctctttgtacaccccagcttaacggtgtatctgtgaggagcaatggtgctatatgagatatggtatggtccattatgaatatcactaatttaattattatttttttaagaatataatttaatttttgaaatttaaattatatttcctctgaagttggtttcaccatactatatgagatatgatatggtggacaggttagaaaataggtctgtgagaactcatttatggagtatctcaaaaagatttgagatgtcactttctcttcccagtggtccacaatgtgattgtgaacaatcatactgttttcttgaaaacaatgagaggatgaactcaaagagaaaatctctgaagaacaatgagtcacaggacctgtacaacctatttaagataagccagtatatgtagtactccttcacctctaaatctagtaggatctcccatcctttagaaagatacttgatattcttataaaggattcagagaaagtgtttctcgaggaagattgagaatataggaatgatcccaaaagtcctacaacgatgtgatatgaagaatcatgtagttacatgaaggtcaataggagagtcccatactgacatcggttaagatatggttatatatagaattttttttttcaaaaatctaggtcaaacattctaaaaataaaaagtctatagagatagatcttgaaaggatgtttattttttatagacaaatatatagaagaggtgttaaaaaggttcagcattaaaaccttcaagagggatccattatcctcttaggcatgggtgtatacaatgctatgtactcgacttggtatatcttattgtgaaagttatgagaaaatattagtcgaatccagactgggagcattggatggctgtgaaaaatatttttgagtacttaagaagcactaagggattattcctcatctttgaagaagggttagagttaagagtgggaggatacattgatgctgatggtagaatatttacatcagtatgtattcttgagtcatgttggtttggtatattggaagggttttaggcaatcaactaatgaaagctgaatatgctatagatgtgtagaatgcattctggttcttatgatagttacagaactggatgtcataccattggatgctttgacattatactacaaagataatgatccatagccatcgctaaggagccaaggtctcatcagaagtccatgcacatagcacagagatatacgtgattatctcaagtagaaatatatggaggtacagagagtagactccatataatagtggtagatccgagtcacttagccagctaaacatcgaagcctgtcttcagaagatggggctcaagtatatgacagattggctttagtgcaagtggaacctttttagatgtgtgttctagaagccaatcttggctaacacatacctttctctaaggcatgttttgtacttgatgggtagtctttataactaatcatgttatttgtgtccatgatttatcttaaaaattaacaaagatgattttgtatacttttaaggtgttgagaatttgagacatacatcattagtggttaatttctaaatactttcaatcgaaggatcatcacgaaagataatgatcaatccatttaagatcagtgtatggatcatctctctttaggacagatgagtttttagtctgcagtgtagagacactggggtgagagtatagatggttgttagagaacaacttgcactgagcataaccaacatgaaaatccatttggatgtctactcactcatcagtagtcttctcgatgctgtagtggtgtgactgatcctttgacctgtggtgtattggctattcgtagtgaggctacttagtttgactgcacattctcttgatccctaaccatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatcaatcttggtagaaaaggagaagtcctatgcgattcataagactgagtttagaaaatctctggtcagagtaagtgtgaatactgaaaaagagtttctacgaaattcacagataaactctagtcgaaccaatctagcatatgactgacgatgggatttgacgagttctccatgacctctgtcaagttgggactcacaataaagggattgtatcacatgataactgcacctaggagtttatttttctactctgttggattaccattacatgctgttaggcattaatggtggattgtgagaacttattaagatcattttcagatcaatgatctttgttgaggtgagttggaatcgtttcagcccatcgaaaaaaattttaatgatactatgatgcagatcatggtgtgtctcactaccagacagaatagaatttgagagatcatgcataaaaggagcatgatctgatcaatagcttggatcatattcaaattattaatcggattgatagtttgaattttagaaactgctaatttgtaatcgttacagttttgacagcgattaattgttagcacagtgacttaattataaatattataatttttttgaaattgattaaattataaattaaattttaattaatttaaattaattttaatttaattagatttaatttaatttaatgttaattgggttcaattatctaaattagatttagattgatcaggcttgacagctttttgtatttgactcgattcagactcgatttgaatccgattaagatccaacttgaactagaagaatcatgactcagagagcccaggttctctaaaactctttcttcaaaaattatgccaagaagggaagaggggcgatgtttttctcatgcttctcttcttgcacgcgtgaaaggggagggggtgccaattatttggattttttttttctttcaaatttttttctatttgaatataattcaaaataaaataaaaatatatctaattgaggtatggaagattttgtttgtgcaacaaaaaatttggataaggagggcgtgcgttaattgtgagtggaggtttctttcttacatcacaactttatctcaatgcttttctaccctttgatttggttttcaacaccctaaattaaaagagattagatctcttaagcattaagaagggtttggggtgtgagggatttgtggtgtgtgacaaaaataaaaaggaaggtgtgaggtcttgtgtgaataagaagtgcgacttctttaggacatcacaatccttcctatgcctcctcctcccttctccccttcatctccatgaccaaatctgatggtgatcagatctaagtagaggaaaagagagagaagaagagaagaaaaattttttttcttttcttcatggtgatctggtttagatcctatcgaatctacacaaaatagttcacgtggtgatctccttcttcaagatctagaagaagagatctagatccaaaattgaggagtgagatctgcaaggtgctagcacaccgatgatctcagcactctgatcagatatttttgtgtggatactagcagaggttggatgcatacgcgattatgatcagaacccagatatctgtagatccaaggtatggagatctgatctccgattatttttgctaaccatttatttttctttttggatttcagatcgtagttgcatgttcagatgaagatctttgctacaatttttagatcagatctagtatgtaaataaattaaaaatattttaatttatttatttttactgcgtagatgtttagaaaaatttttaaactacacgtatgaaatcgttgcaattttttaacagaacctactgtagccaacatacaccgcaaaaatctatataactaggagatcaagtgaatatacagtcaaactatagcaatctcactataagcagtcgaagcactgcatgtcaaaaaactactcacataactacagcatcgaaaaaatcactgataagtaagtaggcatccaagtgacttcttattttgatcatgctcagtatcattattctttaataaccacctacactctcgttcagtatctccataatgtagactcaagactcatctatccttaaaaaaaatgatccatgctccaacctcatcggatcaatcactgtttctatgatgatccatcgatcgaaaatagtttagaaattaaccatcaatgacacatgtctcaaatttttaattcttgagaatatggatcatcatcctgttaattttttggatgattcaaagatacataacaagaatagtattgaaaaattatccaattttattaataaataaaatatatcaagtataaatttatgtcctaaagcaatacaatgtacctatcaaattgacttctagaacatacatctaacatctcataggtcttataatctatcagtaatatctaacagtatgtatatagctatccagtagaatagaattgaatgatcaaactttttttagatgtagttaacacatgatacaattcttctatcgtgagttctgactagatggaggttatggaattactcgtcaaatcctatcattcatcatatatttaatttattcgactcaaatttttgatatgaaaatggtgaaaatttttttcactattcatactgccatggctaaagtctcataaatcacataggaccaactctcttatctatcaagagtgataaatttcatacagactcacatcctattcctataatgaatctactatagccaacatatactacaaggacctatatgatgagagatcatgtatgtataatcaaactatagtaactttattgtaaatagccggggcacgatgggtcaaaggactagtcaccctattgcaacatcgagtaagtcactgatgagtaagtaaatatccaaatgatttcttatattagtcatgctcggtatccttatttactaataaccacctgcactcttgcttcagagtccctacactagagactcaagacttgtctatccttaaaagaaaagcaattcatgcacaaatctcatcaaatcaattaccatccttataataattcattaatcgaaagtatttaaaaatcaatcaccaataacacatgtctcgaatttttaacttttgagaatgtgtcgtcatcttattaatttcatagatgatccatggacacatacacaatatgaatgaaattaaaaatttaattttattaataataaaaaaataaatataaaattatatcttaaaataaatagatgtgtcaatctgactgatttctaaggtatacatctaataggtcctactctatggccctctattcatcttctctcctttagcgctcacacataaatcaagtttttttttaagattttggaattgtacctcctgagaaatggaagtagtctccttcggatctttagtcaattcttctttcttttgtttctctatcatccatcgcaacttctttccctggcagatcagttacattatgaattactagccaccaaatttctctgcagtgtgtctgagttttgtgcctcccctttgatttgattgttaaggtatttgctcctagtttctctattccctataatcttcctttaacactagaactttagtttgtgggggattctaaccctgttgaactattttatcttgtgtttttgttggggatctcttctttttttttgcttttgatgaagtaccagtaacctcaacttgtaaataactagcaactttagccatcatcgaatttggagcatctttctttgattgttcatcagatagaggaccatatcttgaaccaattctattctttccatttcattgaactatgttgcatttcttagtggggattttttttgatgtcttcctagaataagaccatgctccattgtattgtgcagtctcaatagttggtgcagaagttcttctactctcagacataagttgaggggcaattaagactctagctactctaatccaaggaccaaatagagattttttggaaggaatatcacctttggtccaacaatcacaagattctaaagtcctcccaagcaaaccacagtggtagctaagcttcaaaatttcttcacaaataaattcttgccatatccatcctacctcaacttcgaatttactttttggacaaattttcttggtaatatcgatcttcacacagactctagcatagcctatatgagtagacttctccatctactcatccaaaaataggggaattccaacagggcttgcagtccgcagaatgatttctttctcctagagttctaaaattaagaagatctgccaagtagatccacaccttggcttgcttgatagtatccctatcaggttcgaaccccgatcaccaaccttctaaagcaagcaacaagcctgccagtgtccatggtcccttggctaacacccggcctatgtcctcctctgaaggcagattaaaaagaaaaattccatctaatagtggagggatgtggagcaccccttccaatgcccacttggtttttttatttctttttgtcaaaactccaagggaaagtctctaccaagaaacttacctaaaaaagctgatttccatctttgactaccatgatcaagctcctcttgagataggaacaccacttttgtaaatttctcctctagagtggtgatgtctgctttcgtcacgctcaagatctctcaccaaaagtgctgtgctccctgaaccacttgcatccatgatcatcccccttttgtcttcttaatagaaggtcgatctagatggtgttggaaattatgttccaaaatcaattatcagtccattgatggttgtgctagtcaatataaatgtatatgaattggtaaattaataaaattattatttaatttttttcatcataaagtagtgtacatcttcttaatgaactctaatattatgatgaagtccttaggactattctaatcgatataagaggatatatcattaagtccttaaaataagttcatgatcaaatgatacgctgttactaggatgatagtgtttatcgagtgtaggtcattgtgtgtcatatgcgttggttgtcttcataatcaagaggtgaagacactggtatggcatacaagtgagatgtaggagtacatttcattgaatgtgaccaactactgagtattctactatcaagagtagctcatgaaggatatgggtataagtatccctctgatctaagatcatcatggtgacttacaagcaactcattatactttggtgtcagactatctgaatttttaattcagtgacagaagatttttgggtatagtcatggacttacgaagtcggtgtatgagtcaagatgaaattgacccctccgaataagaagaagtaagtgcatcagtatattttaattcaataaaactttggtcagaataatccatgtgatggatttgaaaggttgaaacacaatgtggctgactatttcaaaattgataattaaacttcaagtcaccttgagcattaggatcaaagggataaattatatggtaaccatatgtcaataggttcatgaataatgctttgcaatctttcgatctatccggacatcggataccattgtcatatgatcactttaattggtataaaaaatttattcctatactatcgacttaggttcgaatctataaggtacacttaaaagaaattttcaactaatcatgtagctgatcaatgattgaaaatcattctaggatttaatcattaattcgattaaccttgtacaaaagtaataataaattaatttgctaattattgatgaattaaaagaagattgattaataattagattgctaattaactcaatttgattaagtattaaagtttggattaaatctaattgaattggatttaatttggtttgatccgattagattatgagatgacctaatcgttaaagatgtttgatttctgattcgagcttgattaatttctaatttgattagaatttaatcaagatcatttattatctaattagatcagataatctaattagatctaacataatttggttgcgttaagaacctaattagataagaacatacattcgaattcaaatgggataagaataccccttgcgccacctttcactaagcccatcctttcttcatgcgtgaaagctattttcacatggaatttttggtgcccagaaggtgtgtgatgccttcttctgatcctcttaggattgaaattttgttggattgagtttgaattcaaattggtttgaaattaaacttaaatcaagagtccaagttttgtgggactcttccaagccaccaaccagtcttctttctcatgcgcaaaaggattttttgcatgggttttttatgccaatctgagctttgtcacacccttttctgagtctcttagatgtggattaagtttggttcaaaaaaaaatttaaatctaatttgaattcgtgataagatcaaagtctatttgaatctgaaccaaatcatccaaactcttcatgggatgccactttaagaaggactaattttttgtgtgccaattaaaattagatttggcatgagagaacctcaaagatttggcatgaaaagccaaagagaagggtgggcatccatgcatgagaaaaaggggaagaagatcctctttggggcgtaagatccagggtgggacttctaggattttctagttccagttttgtgagagagaaaaataaaagaagttttgttcttcttcttccacaccatctcctccttgaaaatatccatcttctaatctggagatatccatttgatctaaagaaaggagtctctatcagccatccagagccttcatcacaagctagcactcccagaaaggatgatctgttcgagacttcaagtggaccccctgtagaggctggacatgctgtgcgattattcagtatcagaaaggacctcctaccacatgcatcagcaatggtgatcgtcgacccatgatcaggtaatgggttctgaactcatcggatcagatctaactgttagatcttattcagggcatcgatacgatcgatgcagtcttttctttctgatcaaattttttttatatattattttcatgtcataaatttttagataggtagtttagatctaatataaaatatatatagaagattaaatagtttaatctactactttcgctataaaaattttaaaaaatacatactttgaactgtctgtttttcaacaatggtatcagagctttgatttcttatgacatgaattttttacatataatctgatattaatctaattttaattatttagattatatctaaataattaatttaatatcataataatctgattggatagatctccatagctgtccgattataaaagaaagtaaagttttacgatcctttcttttcattcgatgagattctcatatggcttgtagggatgctgcgtagtctttttcatgaaaatgaataataaaaaaaattttaaaactttattttagatctaaaataatgtatcttaaatttgaaattagagttttgattattggatgattgtttgtaaaaatattttacaaaattgaaaactattttcaaacaccaaaccccaacccatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttagctcgattcaaatctatttaactggattagacctaggattagaaatcattgataatagactatgttagtaattgatcaaatctaattaaaagttaattctgattggatcaattttttttttgattaattctcaatagttgtagttggtcaagtctatgtctttgattagattaagatggactttgatcatagctctgtagtcaaacccaagtctataagttgatcaagttgaaacagactaattagttgatgtctaaggtaagtttagcaatattgattggtggtcattaattgggagctactcgtataaattgagtctatggtgagttaacggcatatccctcccaccgatctcacttatctgaccaacatggtcaattatattttgaatagatcacttaatgattgaggttgacccatgctatctaaaaaatcagtataattgatttaggtgcccctaattcaacttgtcttgagtcctcttcataacttgatgaagttagtgggagaatttatgacttattcaatggaccagattaaatctaatcttctttaatctgacttagtgaagtcagtaggaggattaaaaataactgattgagtcttttctcatctatcaattcaattaattaaaatttttaaaattattaggtctctaaatataaaatagttatggagataactagatcataacctcctattaagttggatgataatgggttcactagttggatgatcattggacggcccaaaggcctagtgctcatctgctattagaatgatcattcataatatgatgactcagtcgagtttctcttatgggtgatcaggatgaccgaccaaagctggatcaaatcacttatggttagattcctgagtatgatcatattaatagttggacctaaccaatcagtggaggccaaagcctattgttaggatcctgaggtaaaattaactactaaaaattatttgataaagtaattggttaagaatctattcatagaatgcacatgggtgagccgaccaaagtcgagctcatgtgcaactatgtggattctagtatctgctaaggaattagaataatttcttgaattggagatagagactaccaattcatttaaaataatgggacaatctttagactaaaatctatatctttaggcttaatcaattcatgcactaattagattttgatttttcttttatagttatggccaccaacttgtcgttccgatcattgttagataatgataaattaaggagacctaattttgatagctagtatcgaaaattgaagatagtcctagagtacgagtggatcttgtatgtactgatagatctggcatccgaggagtctgcttccaacactcgtggtgcggtttgagatacttacttgaagtggctcaacgaccgtaccacagtcgtgtattatgcgagcggctatgaatgatgagttcagttgtaaatttgagaaagctcagctagaagaaatgctcaaagtattgaacgattcttttgacactcctgatgatgttgagcggcacaacactagttgtgctattttcaatgccaggatgagggagggggcgtcagtgatcgatcatatattgtacatgatcgaacagatcgagcaccttaacaagcttaactttctcttgcatgagcagcttggaaaagatgtgattctaaattttttgtcgaagtcttacttactatttctcaatcattatcgaatgacgaagccggtagtaaactaccacaatctattgaggttgctgcaaatttttgagaaagatcaccagctccacaaagagacggtgaatgtaatgggagcatcttcttcaaacgagcatcatccctttaagaaaaggaagaaaaaaaaaataaagtgccaagtgctaggggtcagactgtgaagttcaagtccaagtctgatcaaagtcaggcagagtgcttctactataagaagcaaggttattggaagaggaactatccttaatacattatttttcttgatccaaacaggcctaagaagaaaaagcaatcgattgctaagcaaggtaattaaatgataactccttgtaactttttaatttatgatacaatgatctgagtattagatattgatagtcctattaatatttgtaattcgttgtagaaacttcaggtcagtaggagatttgaagacggtgagagagattcctaaacattgaagatggaagatcaattttagttttagctttaggaatcgtcaaacttatattcaattctcatatcattattcttagtaattatcattattgtcctagtttcttattgaatgtaatttttgtaggccttctggccaaaaaaaattatgaaatttcaataaaaaaaattttatgatattattttgaatggtgttattgtaatgcacagataattgaacaatggaatatattttgtattgcgacctagtgtaatgtacacatcgagaaaatatcctaggatagataatgtcttgaagagctatctttggcattgtaagctaagtcatatcaacaagaacaggatgaacaggttaatccgagagaaaattcttaacaacaatgattgtgaatcattgccaacctgtgaatcttgtctacttaaaaagatgaccaaaccatcttttactgaaaaaagtgaacgagctagtgaggttctaggtcttgtatatactgatgtatatggaccgatgagcacaagtatgagaggaagacaataatacttcattacgtttatagataacctaacaaggtattggtatgtctacttgatgaaaaataagtctgaatcatttgaaatattcaaacgattctgtaatgaggtagagaaataaactagaaagaatattaaaactcttcgatctgatcgaggaggtgaatacctttttgatgaatttctgacacatctaaaagagaatgagattctcttacaatggactcctcctagaatgccacaatataatggtatctcagaaaggagaaatcgaacattgttggatatggtttgatccattatgggatttttgaatttgccaatctcatttttgggatatgcgctcgagtcggcttgctacatatttaataggattctaagtaagtctatgaataaaacaccatataagatatggactggacataaaccactactctcacatcttaagatttgaggatgtccgacttatatcagatatttaaaaacagacaaattaggatctaagtctgacaaatgtatcttcatagggtatcctaaaaaaactaagggatattacttctaccttattgataaataaaatatattcgtgagtgataaagcatactttttagaaaaaaaaaattcttagtgaaggaattagtgcttctcaaattgaacttgatgaagttcgatggatagaagaaccgacacaatctagtgaacccacagaatccaatttgattgaatcaaatctagaacctattaatgatgcaccattaaagagatctgatagagtatcatgcccactagacagatactatagtttcttgatctgggatgaggatcctgaactcaatgagaacaacaaagatccaatctcctatatggatgcaatacagagatctgactctgataagtggctagaagtcatgaaatccgaaatagagtccataaaggccaataatgtatggacattagttgactcacctgaagcagtaaaattcataggatgaaagtggatctttaagaggaagaagggcacagacggcaaggtagagacctatagaatccgtctggttatcaagaggtatcattaatgttatggtattgactatgacgagacgttctctcctttagtaatgctaaaattcattcggatcatgcttgcgatagctgcatatctagactatgaaatctgataaatgaatgtaaaaatagtttttcttgatagtgaactagaagaagaggtgtatataatacaacctgaaggtttcacatccacaaatgagtctaaggtatgcaagctttagagatccatttatggattgaagcaaacaagtaggagttggaacatgtgttttgataaagtgatcagaacgtataactttgttaagaatgaaaaagaatcctaaatgggttaacaattctatggtagtattttttattttgtatgtggatgacattctcttaattaaaaatgatgttcctgcataacaaggaataaaagtttaactgtcatctcagttctccataaaggactagaaagaagcattctatatccttgaaatgaagatctatagagatagatctaaaatggtgcttagattgtctcaatccacatacttcgacatcatgctgaaatggtttagtataaaaaatttcaagaagggctatctcccgataggtcatagaattctctctcaaagagggattgtccaacaactcaagagagagagcatatgagtaggattccatatacttcgataatggattctataatttatgctatgatatgtacaagatcagatgtggtatactcactaggagtaatgaacagataccagtctaatccagaggagaaccactgaacggttgtaaaaatcatctttaagtatttaagaaaaactaaggatcagtggcttgtttatagagaaatcgacttaaaatatgtagagtttatagacttcaattttcaatcgaagcatgatgacagtaagagcatgttggattacatctatatcctgaatggtgaaacaatctactaaaaaaattataagcagcacacagtagccgactctacttacaagacagaatatatcacggcatccgatgctacgaaagaagctgtatggttacagaagttcatcgacaagcttgaagtggcaccctccctcgatagccctattttgttgtactgtgacaatactggcaccattgctcaagcgaaggaatcgaagtcacatcagcataccaagtatattctatgcttctactacttgatccggaagatcatgaatcgaagtgacgtcgagcttcagaagatcgacggaaaggagaatctgattgatccatttactaaagccctcagtatcaaggagttcgaagatcaaaaactgaagatgagtatacaatattgtactgattggctttaggccaagtgggagttattgaaaattgtatcccaaagtcaatcgtcagtccgttgatggttatgctagtcaacataaatatatataaattaataaattaataaaattattatttagcttttgcatcataaagttgtgtacatcttcttaatgaactccaatgttatgatgaagtccttaggactatcctaatcgatacaggaggatatatcgtttagtccttaaaataagtttacgatcaaatgatatgctcttactaggatgatagtgtttatcgagtgtagatcattatgtgtcatatatattggtcattctcataatcaagagatgtggagacactggtatggcatacaagcgagatgtaggagtatatctcattgaacgtgaccaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaattgcatatatacccttataaattttttttttgcataaatacccatacgggtatttcagtcatttaaattttaaaccattaatttttcaacggcattagatgacgttggtatatatacaaaaaataaagaaaaaaaagggtatacatgcaaatcaaatattttataaggatatacatgcaaatatcaattttgaaagggtatccatgcaaatttggatgtttagaagggtatatatgcaaaaatctcaaattaatttattaattattgatgaattaaagaaaaattgattagtgattagattattaactaactcaatttgattgagtattgaagtttggattaaatctaattgaattggattcaatttggtttgatccgattaggttataagatgacctaatcgctaaagatgtttgattctagattcagactcgattaatttttaatttgattagaatttaatcgagattatttattatttaattagattaaataatctaattgggtctaacctaatttgattgggttaagaacttaattagataagaacataaattcgaatttaaataggatgagaacacctcttgtgcttcctttcactatgcccatcctttcttcatgcattaaagttgtttacacatggaattttttgcacctagaaggtgtgtgatgccttcttctgattctctttggattgaaattttgttggattgagtttgagttcaaattggtttgaaatcaaacttaaatcaagagttcaagttttatatgactctttcaagccgctgaccaaccttctttctcacatgcaaaaagattttttgtgtaggttttttgcatcaatctaagctttgtcgcattcttttctgagtctcttagatgtggattaagtttggttgaaaaaaaaaattaaatctgatttgaattcatcataagatcaaagcctgtttgaatctgaaccaaatcatccaaactcttcatgggatgccactttaagaaggacagattttttgttcgccaattaagatcagatttggtgtgagagaacctcagagatttagcatgaaaaaccagagagaagggtgggcgtgcatgcatgagaaaaagaggaagaaaatcttctttggggcgtgagatccagggtggcacttctagggtttcctagttctaattttgtgagagagaaaaacaaaaagagttttattcttcttctttcacaccatctttttcttgaaaagcttcatcttctaatctacaagtgtctatttgatcttaagaaaggagtctccatcagccatctagaaccttcaccgcgagctagtactctcgagaaggatgatctgttcggggcttcgagtggaccacctgtagaggccggacatgctgtgcgactgctcgatattaagaaggacctcctaccacatgcatcaacagtggtgattgtcgatccataatcaggtaataggttctgaactcatcagatcagatctaaccgttaaatctgattcagggcatcgatacgattgatgtagtcttttctttctgatcaaatttttttatgtattatttttttatcataaatccttaggtaggtagtttagatttgatctaaagtatatgtaggagattaaattatttaatctactacttttactgtaaaaatttttaaaaaatatatgctttgaactgcctgttttccaataaatggcccctttaagacaagccatctggtttcttttccttcggatctagcattattagtctctcctttagaagctgcagtaccaaatctggttgattgagctccatgtcagttagatttggccccttcctctccaacgagggttcaagtgaaaccctagtcatctctgttcctattcctctctttccactatttttttcttgacgtgcgtacttgttgggagactaggttaggaggttgacatatcaaatatttgttggactagtctatgttgatgtggtagactaattggagggtcgcaagatctgagcatgaaggagatatggaactctagcttatgagacgaaaaaagggatagctggcttgacattaatcctcctatgttttcacctatatacatatattaaaaaaaatctagtgaaatagaatacacccctcttccattttcctccctgaatgcttgcatccttaagcgtatatatatacgtactactttgcaataacaaccatcgaggagaaacaaattaggcctcaagattgagaggagcagctgggatagacaacaatatatatacggtggaggatgccttggagagagagacaaatggaaacagtaactcaaaaactttaattacaaaagtcactcgggtgccttgcaccaattgcactagttttacatcaacaccgctttattcagtttcacattcacaatgtcaattaaaagggtacaatgccaatacaccgcattggttggatcagttttttaatttacttatgtactttctattagatgcacaccttagaagtcaatctgactgatacatttattatttttaaaatataattttatacttaactttattatttattaataagattgggtagtttatttttattcatattatgtatgtatccatgaatcatccaaaaaattaataagatgatgacacatatgaagaaaaagaaacctgcttctttgagagaatgaggcagatagccagagtgcatctaaaaattttttacaataacttgataaagattgaatctttatctgattcgcagtagaatagggatcaaatctcctaagattttgaatccaaaatctcacgtaggtctgaatccacaaatcctctactttgcgtgcacaccaaacttcacagaaaagtgggatgaagtcttggattgaagcacctttacaagaaaataagggagtagagagaacctctgatgtaacacctcacaccagcaagaggggatgcccaaggagacttcatgccttagagaagatggatgcccaaatgggaacacgccaagacaagggtgacgctaagtcttccttcatgactcctgtctctctctctttctcaccttagcatacaatctaattattatgctatgatagttagaggtcctccctatttatagatgattttctatgacttataagactaggatttctaattcaaacagactttaaattaatccataacttatcaaagaaagagttctaaaggaaaaaggaatggcgcctaactagatgccctcatgcacccatgcctacacccaatatggggcggcaacaaccagcaccccacctgatcttggccagccatgaggagagagagtttcagtaaaagtggactctaaggatctaatccaaatatgaatcaattcgaattcaattcgaatctgattcgaaataatttcgaaaaggctgtcaatcctaaactgtttaggatttagaactaagtctaacttgaatttttcaatctaattaagtctaattaaatcagatctaatctaaaattaattagtacttaaattcaatctcttatagactccttggattatagttcaaatcttgttcatcttcagaattgaatctaaatctcatgtctagtgctagctagtcatagtcaactatttaatcccatatgacccattacttaattctcaatcaaattagtctatatgtttcatcaagtcacatacttccaaattaaatatatagtcataggtcaattctttcctacatcgtctaattttgtatgtgactccataggttcgaatactaagctagtagcacagaaataattttttgtactaatcaaaattatcatctagcaatggttttcaatgtccgaatagattgaataattgtaaggcaatattcaaaaacctatgcatatggttactgcataattcatccctttgaccctgaatgctctaggatgatctagggttaactgtcaatcctgacagagtcatccatgtatttcaatctttcaaatccattacatagattatcctgattaagattttaataaattgatatatagtgatacatcagctcctataatccgaagaaattaatctcatcttgatccaacacagactttacaagtacttgactgtacctagtagccttccgtcactgcattaaaaatacagatagtccaacaccaaaacatagtgagttgcttgcaagtcactatggtgatctcagatctgagaaatacttatgtccatatgcttcatgagctgctcttaacagcagaacgctcagtggatgagtcacttatttagtgatgatgtactcttacatctcacctgtatgccataccagtatctcgatactccttgatgaagaagacaaccaacctatatggcacataacaaccttcactcgataaacgtcatcatcctttaatgacgtatcattagatcgtgaatatatttaagaactatacgataaatctttctttatcgattacttcatagttctaagaactttatcacaatacaagagttctataaaaaagatataactttgtgataaataatgtcagaataatttttatttatcgatcaataatttatatataaaaaaatacaatcatccatacaattgattttaggatacattttccaacaactctcacttggactaaagccaatcgggatagtatcttatacccatcttccatttgtgatcatcgaactctttgatcttgagaaatttagtgaagggattggctaggttctcttttccatcgatcttctaaagtttgacgtcacctcgattcacgatctctcgtacaaggtgatagcgatgtagaatgtacttggtacattggtttaactttggttctttcgcttgagctatgactccaataatgtcgcagtatagcaaaatgaggccatcaatagagggtgtaactccaagctcggtgatgaatttttgcaaccacaccgcttcctttgtagcatcggatgcagcaatatattctactttgcatgtagaatcagtcattgtacattgcttgaaactcttccagcatattgctcctccttttaagataaatacatagcccgacatgcttctattgtcatcactatctgactgaaaattaaaatcagtgtatgttgaactgtttcaacatagtattgatgtacgtgaattgagacaatccaagtaatcttctaaatttatccctatagatctttatccttaggatataggatgcttctctcaaattcttaatggagaactgtgatgataaccatagcttcacactctgtaaagctaagatgtcattttctatttacaatatgttattcacataaagtacaaaaaagatgactacaaaattgttagcccacttgtagacgtaaggttcttctccgttcctaataaagccatacattttgatcactttatcaaaactcatgtttcaattcctagatacctacttcaatctatagatggacctatttagtttgtacaccttagattcatctatgaatgtgaacctttcaagttgtatcatatacacctcttcttctagctccctgtttagaaaaataattttgacatctatttgtcaaatctcataatctaagtgtacagctattgcaagcataatctggatggacttgagcattaccacaggagagaatgtctcgtcatagtcaatactataatgctgatagtaacccttgacaattagacgggctttacaggtctccacctttccgttcgctcctctttttttttaaaaaatctacttgcatcctatgaattttattccttcgaacggatcaactagtgtccatacactattgatcttcttggactccatctcggacttcatggcctctagccatttctgagagtcggacctttgcatgacttccatataggtgatggatccttattgttctcatctagtttgataggatcaccatctcagatcaagaaatcatagtatctatctgattgatgtggtactctattggatcttctcaatggtacctttactggcttaggatttgatttgtcaatcaaatctgattctgtgtgtgtcaatttttctatctcataaattttatcaagttcaattttatagatattagttccttctttaaaatttttttttttcaaaaagactgtcctgttgctgactaacacattttgttcttcagcaaaataaaaatagtatcctttaattttctttgggtaccctatgaataagtatttatcgaactttagttcaagcttatttgtctttaaacgcttgacataagctggactgaagcgaaaatttagtgcaggggaaaaatggtaattttaaaactttttcaaaattactattttacagcagaattattaattaatctcattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattcatgtactaatacaaaaggagcacaaccgtcaacaggctgacgattggctttgggacactattcccaacatggacacccccagaccttaaggtgtgagaacaccgacctacgtcttgtccatatttcatatggagttttatcgatagacttgctcgacactttactaagtattgggtttcgacatgcacaatggaagcactgatgtttaaaattttttattcaaaatacctcagcacaccaaaaattcttaagcccagtaatcacctggacaatacaaacaaagaacaatatgtaatcagagggtatcgagacttacctgtctcactaaattttcaccggcacacaagtgtctaccctccaatggtatccacacaaaaattgtactaaggacagtgctccaacttaagtcttgcttcaagagttctagcccctagaactcgactagcctcgcatctgaaagtcaatgcctccatttaatcatcctgatcatcagcacatattttgaaccattgaaatgcttcttaggatttctaattttcttctctaagatctttattagccttgatttaataggattagcccttgtcctaaaatgactaggctgtgtcctaatacttaggctaaatagaagaactttggatagcactttgtcctgaaaagaaaatcacaccgaagtctatttgtcgtgccttatttatagagtcaaaagggtgctaatgaagcaccacatcccattccaaatgcatatctaaaatgctcttatcagatttgatatgacccttggtagaaggactctaaagaggcatatacagtgtttcaagcttctccccatgcacgcacccagagagggcattttaggcatcatttgctaattagaaaattttcaaaaattatcactagaatttcctttcaaagatgattcagaaaagctaagatttctgatcagaagatgcctccttctacttaaaatagaaggaaaagtcgcaaccctatgcacgaccaataaatcttgtgcgcatacctactgaagagatgcctttcttgcgacctttccttaatcagatttaatttaggtttgccacatagagtcaccatttaaaaataatccagataagaaactgattaagaagatgcctctctctgcttaaggaagtaggagtttcacattcctttgcgcattcagaaattttttgcgcatgcaggtcaacattcttggtgtcccacgccaaatccagaagccaataaaatcctcaaaaatagtgctgatgaagatcaaccactaatcttcatgtcacatgagcttcaaacccatcagagaaggatttccaatccttcttatgccaaaaactttatcgcacgcaccctcgaatttgggtgcctagagtcccacttgattgggtctcttgattatagtgtgtggctaggaatttgggtgccttatttggctgcctcttggaggctaactcagatctaaaccctaattaaccattaggtcaattaggtttgatcaattttgcaagattcaagcccaaatcaaaaccgattcaaggagctagggtttctacatgtgctagcatgcttactggaagccctgattggatcccaattttcaatcaactatatcaaatggatccttggccaattctttaatacgtgtgaccctttgagtttctatctagccagtagtaggttcgggtgctagttagcctaattcaattagactacttctaatcgattaaggtccaaactatgccaacccatgttgtcaaattagaatcctttctaatttactcatgaattaatcactttaattcataaaaatctacaaggcaagattgatgtccagcaatatatcatgcctacctagaagataagaaatttgataaaaatatcaaatatatccttcagtagcgagttgccgtgtaattcaatcctttgatcatcctacatcccgaatatgtctgtaagtataaaaatatatcaaactcactaacatatttttcttgattatccatcaatcagtgatgactcaatgataaaatattagaaaccttctaatattcatcctactctggccaaagattttcaaagtcatctagagatgataatacataggatgacatctcctcttactaggagtgatcgatttcttgttgacctactcacaacctccatgcatattcttctatatctaaaatatctgattcatgaattaattattatgagtgagtatgaactaaaatatagattcttgtgcataaggttctatggtgatctcaggtctaaagatcatttgcacaactctcacttagagaatcatcttttgacatgcagataagactccatgaaatgttctctcttagtgaatcaattcagtaaatttattttctaatgagcaccaacatctttatattagtatctcatataagtggcttatgagatcagccaccctctccatcgagtatacataggatatgccagtctatccggaatattaatttctgactcaatgctcctatgatccaaaatattttagattagaattttagatctcacagacatgaactctatttatgtcctctaaaatttttgacctaatctatggggttcatcataatgttaatagaatacaataagatgcggctataataatgaatcataatgtctcaattcatagaaatatgaataatatcataacatgagttggaagattatctagaaaaatcctatcgcatcactcatgcgataggcttgtagggcactattctttcaatctcccacttacactaaagtcaatcatccaaatatctcaaacccttgagatgacgatcaaacagctgctgcagtaaggccttggtcaatggatctactatattattctttgaatcaacaattctatgatcccatcataaatgagatggaagcatcttaggatgtgctcaagttttcaaaagagaccttggttcaaactctagaactaaacccaattatgagatgaactactccatccagccaacttccccaagtaacttcacttagcagcaatgtaatctagttccatgcttgagtcagctacattgtcattacaaactcttctaactcactgttatacttttcaggataaactcatatcttgatagagacttgctatcatctgaatctaattgaaaactagaatcaaaatatccttctagtttcaactctgatcctccataaaatattagaaaagcatctttagtacttctcaagaacttaagaatatttttcattattttttcaaacgatcatcttctggatcagtctgaaaatttactagctatgcctaaagcataaaatcccatcaagcttagtacatagcatctcacacaaaatcaatcccacattcgaagcataagggatgatatcattctctctcactcttcaggtatcttaagtgacatctgcttagagagagatgtatgctttgacttatagataagtaaactcttttactagccactgtgttgaaccatttcaacacaaagtctatgtaccaagactgggacaagccaaatatccttttagctttatctctacagatctatatatactcagtatataggatgctttatccaagtctttcatgaaaaatatctttagatagataatttttgatcattaaaatattgagatactatttccaatcaacaaatagaactaaaaagataatagtactttcatttgtcttcttatatacacatgatttatccaccttttgatgaagccaaactcatttgactatcatattaaaaatagatgttccaactcttcaggtcttgcttcaatccataaatggatcacttagcttgcatacttgatttgtcctcctactggagataattttttttgaataaatcaaataaaccttattcttcaaaaataaatttttaaaaaattggcttttgacattcaactgccagatctagaatcaaagtatgcaactttagcaagcataatctgaatgaacttgagcattgtcattagtgaaaattttcattaaagtcaacttcatgcctttgtttttgaagattcatcttgaagattcatttgcagtctattgggatcacaccctcatgagcatcaaccaaagatcatacttgattgctttacatggagttcatttcaaatttcatggcttctagccatctgtcagagttttttctcatgataacttccatatatgtcagtggatcataatcttgaataatctgggtctcgttgtcattcctaataacaaacccatcatagaggtgcttagtgcactctatttgacttacggagaggatgtgtgtattatggatgtacctcattcttagatacttctggttgaagatcactttgtgaaccaatcacaggtgactatgggatagtttgtggccttaaacttctacaagttcaaattattctcctactgtctctttttaggataaaatatttttttcaagaaagtgacatacttactaacaaatatctattattgagtaggatggcaaaagcagtattcaatactcttctttgaataactttcaaacttttacttttcgaatctaacacttaacttatatccaaaatcacttttgacataaataggacaacctcaaatttttaaggtatttgagatttgtccatttttccttctatatcaaatatggagttctagcaataatcttgaagacatcctgtttataatatatatggcaatttctagagcaaatcatcagaataatattgaaagatcaatgaagtacatcatagaccgtaccatatctaatagagtgtaattcctccaatctaatacatcaattaactatggtatattaggaggtatctaatcagagagaaaaatagatgatcaagaaattcaacgaataagtattcatctcttcgaacaaatcgaagaaattttgatactattttcaatttatttctcaaccatacaatgatactccacttatcaaaaagctttggatttatgtttcatcaaaaacataaatccaaccttgataaatcatctataaagatgatgaattaggaatattcttctctagcttgagttgtcataggtccacatacatataaatatacaagagttaacaactcaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccttaactcactaaaaagatcgaaatgatagtgctagagaaatgtgataaacatatcttctctctaacatttcatactttcatcaacataacatgtcacaatgaaaacagataatatcttaaaaggacattcattgcttctttctcttgaagatgcttgtcttaaagttcaacttctttgaacccttcctaccactcttcttgtccataaaaagaagttgagccttatcactcttgatagagctctctgctacttttaacatgttaagtagcattggcaagaaacttgtctaatttgttcatataagagattatcacaaactttggacgaagagtttgggagactgaaagatgagatcctgacttagttctccatctatctcaaaatctaattgactcaatctagtgatcaagtcaataatcaagaactgggcctgaatggataagcccttagacaacctggctcagaacaactacttagatatttcatatctagcagtttgagctctgctctccattcaactccttaagattaaggaatatagaatctagattcatctattcatgtagtctgtgcaactcattgcacatcaaggccaatatgatagacttgagagtcgaacagtcaatctaccatatcctctatgtggctctcacttcttcttgaagcatctttcttgatctaagaagatcaggagaattgagaatataggagatcaactcctatgcgaataccaattacaagtttctcaaccagtccacatagttcggatcggtcaacataaatgcatcaataatataatatagtgaaagtgaagatgccataatgcataatcaaaacataagaataatagaagcaatagactactcatgtagacattcataactagatgaggttttcagtctagttatgtcttttactattttatcatgtaccatagccctctcctatggtagatgagaaaatttctaaccaattttttagtggggttgagattctaattcttcataaatgccttatgttacacaacaaacattcatgagttcaaaagtaggaaactgcctttccaattgcaattcgtgcaactctcaacaaaactcctacctctaagacccttatagtcttgtgttacacaacaaactataacgtcttagtttagtcagacccttcattttcatatggtaatattcaaataatgttgcccttatattacacaacaaagcaacaccatcaaatataccataaagccctaatggcatcaagacaatcccaaatcaacacctatagtaagccttgtgttacacaacaaacctattatagtgttaacatgattttggcttagcataaaggaatgcattggtagtgtcctaatcattaagcattttcaattcaagattaaatcaataaaattgactagataaatgggagagaggtgggaggccccccattcttaccttagacaccaaatgatttggccagataagaaacggacccaattaaagaaccatgatctctttaccttcttagaaccactttcctagacaattgatcaatcattttttgaatgaatttgcttttgatttccaacactataactaaatataatttttaggagggctttccagtctcatgcacatcctatcttacttagcaaatcatatcacatatgctataatatatcatgaaaagcataatatgataataaaaaaataagagcatgctgtcccatgagtgtatagttatatcatcattctaggataatgtttgcagcatagcggacatccaccgctatgccaggaaaatcttattttagaatgatgaacataacacatgcattatagtgcataaaaaatataataacatatgattattttcataatgaatcataatcataatcatatacttctaaatacatttctatgattgattagggtttatacgttcaatcgaactcattaccttgtccgattcaaaccaaaatgaaaaaccctagcattaaacaccaatcaagatgacatccaatcctttgaatgtattgatcaaggatgactctgatactactagtgcgttttgacaaatgcagtagaagcactggtgtttaaattttttttttcaaaatacctcagtgcaccaaaaacccttaagctcaggaatcaccctaataatacaaacaaagaacaatatgtaataagagggtatcgagacttacctatctcgctaaattttcataggcacacaagtgtttgccctccaacggtatccacacagaaactataccaaggacagcgctctaacttgagtcttactttaacagttctagcccctagaactcaactaagcttgcatctgaaagtcgatgcctcctctaagatcttcattagccttgatttaataggattagcccttgtcctaaaatgaccaggctatatcctaacacctaggctaaatagaagaactttggacagcactttatcctgaaaagaaaaccacaccaaagcctatttgccgtgccttatttatagagtcaaaagggtgctaatgaagtgccacattccattccaaatgcatatctaaaaagctcttatcaaatttgataagacccttggcagaaggactctaaagaggcatatacatcgtttcaggcttctcctcatgcgtgcacccaaagagggcattttaggcatcattcactaatcaaaaaattttaaaaattatcatgtggaatcttttttcaaagataattcagaaaagataagatctctgattagaagacacatctttctgcttaaaatagaaggagaagtcacgaccctatgtgcgaccaataaatctcgtgcatgtacctgctgaagagatgcctttcttgtgatcttttctttcaattcagatttgccatatggagtcaccatttaaaaataatccagataaggtaagaaactcattaagaagatgcctctttctacttaaggcaataggagtcttcacatctcttcgcgcatccaggaattttttgcacatgcaggtcaatattcctagcatcccacgccaaatcaagaagccaataaaatcctcaaaaatagtgctgatgaagatcaatcactgatcttcatgccacatgagtttcaaatccatcagagaaggatttccaatcattctcatatcaaaaaccttgttgcgcatgccctaaaatttgggcacctagagtcccacttgattgggtctcttgattatggcatgtgactagaaatttgggtgccttatttgacttccccctagaggctaactcagatccaccctaattaaccattaggtcaattaggtttgatcaattttgcaagattcaagccccaatcaaaatccattcaaggagctagggtttccatatgtgctagcatgcttattgaaagccttgattggatccaaatttttaatcaaccatattaaatggatccttagccaattctttaatgtgtgtgatcctttggatttctatctagccagcagtaggttcaagtgctagttaacctaattcgattagaccctttctaattatggtccaaactatgccaacccatgttatcaaattagaaccctttctaattgactcatgaattaatcactttaattcataaaaatttataagataagattgacatctagcaatatatcatacctatctagaagataaaaaatttgataaaaatattgaatatatccttcagtaacgagttaccgtacaattcaatcctttgatcatcctgcattccgaatatatctgtgagtatgaaaatatatcaaactcactaacatattcttttcgattatccatcaatcagtgatgactcaatgataaaatattagaaaccttctaatattcatctcactttagctagagattttcagagtcatctagagataataatacataggatgacatctcctcttactaggagtgatcgattcttcattgacttactcacaacctccatgcatattcctccatatccagaatatttcattcatgatttaattattatgagtgagtatgaactaaaatatagattcctgtgcataaggttctatggtgatctcaggtctaaggatcacttgcacaactcccacttagagaatcatcttttgacatgcagacaaggctccatgagatgttctctcttagtggatcaattcgttgaactcatttcctaataagcatccatatttttatattaatatctcacacaagtggcttgtgagatcagccacccttttcatcgagtatatataggatgtgtcaatctatccgaaatattgatctccaattcaatgctcctatgatcaaaaatattttagattaagattttaagattttaaatctcacaagcatgaactttattcatgtcttctaaaatcattaacctaatctatgagattcatcataatcttaataaaatataataagatgcagctataatgatgaatcataatacctcaatttatagaattatgaataatgtcataacatgagttggaagattacttagaaaagtcctgtcgcatcactcatgcgatggacttgtagggcactattctttcattaagaatatagcaggcagttttaagagcatatcttcaaaaggagattggtagataagtaaagtccatcatggatcaaaccatatccaataaggttcgatttctcttttcagacatcccattatattatggtattctaggagggatccactgtgagagaattttattctcttctagatatgtcagaaaattattgatgaggtatttacctctttgatctaaccaaagtatcttaatactctttccagtctatttttctactttactatgacattgtttgaatattttaaatgattccgattgatgcttcataagatagacatatccatacctcgatagatcatctataaatataatgaagtagtagtatcttcctctagcacctatattcatatgtctacatacatcattatgtattagacctaagacatcattggctctttcatcttttttcttaaaaggtgatttggtcatcttaccaagtagacaagattcacaggttggtaataattcataattattaattttaaagatattctctttaattaacctgtctatcttcttcttgttcacatgacccaacctacaatgccaaagataagagtcactgacattagctattttagaatatttatttgatatgttcattacaccaacagactgtgataatatgtatatgccatatcttaattatcctcgcataattatagtatcattcacaataatatcataaaaattatcttttattaaaaatttataactaaatttagtcaaaaaacctacagaaatgatattcatcaaaaagaaaagataataatgacaatcatctaacatgacactactggattcgaaaataagctgcatagtttctaaagctagaactggacaagatttctatctctaacgttcaggaaccactcgtcttctctaaattttttattgatctatagtttttgcaatgaattatatatattaatcaaacttttgagattcaatatctagatagtagtatcacaaacaaagaaattataaggagttatcatataagtaccttgtgaaacaatcgattacttgcttctcttattcttagatctgtttgggtcaaggatagctatataagtaggatattttttttttcaatgatccagcttcttgcaaaagaagcattctgtctggctcttatcgactttcgatttttggctctgcttaaacttttgatcaacggcatgattcttctgcatctttttttttcttttctcttttagaggatcgatgacctatagacaaacctcctactacatgcacaggctccttctgaagctggtggtccttcccgaatgtctgcagcaatcctagcaaaccatgatagttcactatatgcttagtcattctgtaatgactcaagaaggataggtaggattttggtagcgaattaaggatagcatccttacctaattattcatgtaatgaaaagtcaagtttgcttagacattcaatctgcttgatcttgtataatatatgatcgatgactgaagtctcctttcatatacgggtattgaatactgtgcaggaggttttatatctctccgcatcctctgaatactgtgcaggaggttttatatctctctgcatcctctggaatgtcgaaaaacttattcaacatttgaatcatatcctctgactgtgcatcctcgaacttatggttaatgcagagttgccctcataatataatgcagagttgtgcaatcattgagccaattcaagtaagtgtctctcacgacacaggatgcattggtagaagattcttcaggtgcctgatccgtaagcacgtacaaaattctttcatgctccaagatgatctttaactttcgatactagctatcaaagttggatctggtaagcttgtcgctatccaacagcgaacgaaatgatagtgtgttggccatagctgaaacgtaaatcaaaaatctattggtatatgaattactttcaatcccgaagatatgaactttagtctaaaggttcttccactattttatacgacttgatagcctccacctccaattcgagaaattacattaattctttagcggatactagaatctacacagactgcattcagatctgagtatggctcgaccaaccctagtgcatccatgggtaagtttataatcaattatttcttcaaacaacttctaacaattagattttgcctcagacctctcttcaacaggcatgtggtgcctccactgaaaattttggttagatccaaccattaacatgactataccaagcgcatccaacaaacaaatgttcagattcgagtatggctcgatcaacctgagcattgatctgaatggcacaataagatggtcatacgataaatgataatttttatatccaatagacatcaagcgtatagcgcctccaatgcctattttgaatattggattcattataatacaccttaataggatgttatgaacaagttatctccataactatatcattttaaagatccaataatttagataatttaattttattgatttgacaataaaagaaaaaattaacctgtaagtcttaaatcctctcactgactttaccaagtcatgtagaggattagacacaagctggtctaaagatacctgaatcagtcatactggtttatcttaatggcatggatcaactcgaattgactagtgacctaatcaaaacataatatatcatgttggctaggtaagtgagatcagtgggagagatatgccattaactcatcgtagacaccatataggtgaataactcctaattaataaccactggatcaaaactgtcaaacttattttagacaccaactggttaattagtttcgatttgatccatcagaagattcagactcaaccattgagccatgatcatggtccatttagtaaggtcaaaaatatggactttatcaagcttcaactattgagattaatctagaaaaattttgacctaatctaattcaatttttgattaaatttaattaatttttttattcagtttatatttctttctaaccctaggtctaacccaatagaaggacatgatttatgctaacccattgcccatcgatttatgtggtgtcttagtaatcttcaattctcaaatctagatcgtttaaacttaattctaaattaagtatatgaaacatgtgtttcaatatatagaactattctactataatttcaagtgaagcataccatatgttttatatcataaaaataaatttttatatatatgttgaacaattaaacatacataagtatgatctaaacttcatacatacatcatatgtaccatgataatctttagctcagtattaattatatctaacataacatgctattcagattttaaaataatttttatgtctgaatttatcttattgtaataaaccataaatcactttagatctaatctaaacttatttatgatcaaaataatttataaaaatctattcactcttcttctttatgaaactagatcataatgacatccttacacgtcataagagaactcattgaatggacaaaaaaaaaattaatccctcctatctcttatgatcggacagtctggtgatctcatcaatctgagtactgggctactaagatctgaaatcttatttcatatgaaattatatcaatatgtaatttgacaaaatattttatgtcatgaacatgactttgatctcatcaatcatgctcttcatctaacctaatcagatttgaagcatcatatacatcatatcaaatctgaaatatattttgtactgattataaaatattaatttcagatctgatatcatattgaaaattaattagatacacatatgaacacataaagattaatttttttgttagatctattttgatgttgtacaaaattttgttagaaatcacatttgaaaatctgtccaaacatattcaattcaggtctaaaataagtctaacttcataaccaaaataataatattaaaattttattaaaattaatttaaaataaattttaaaataggttattaatctaacaaaattcagcaaataaaaaaaattctgttataacagatttataacaaaccttaatcaacaattgattaggttcttgtaacctaatcaaaattagatcataaattttatttaaatagatctaaattagatttaatatctaatataaaattttaattatatataatatataaataaattaaaaaaattaattatgcatccatgtatcaaagtctagctcggatactaattaaagagaaagaaacctatttctttaggagaatgagatagatagccgaggtgcatctaaaatttttttaaacaacttgataaagattggattttatctgattcacagtggaatagggatcaaatccttaaaaattttgaatccaaagcctcgcgtaggtctgaatctacaaaccctctatctcgtgcgcatgccaaactttgcaagaaagtgagatgaagcctcagattgaagcaccttcacaagacaacaagagaggagagagaacttttgatatgacacctcacaccaacaagaggggatgcccaaggaggcttcacgccttggagaagagggatgcccaaagggggaacatgccaagacaagggtgacacccagtcttccttcatgcctcctctctctctctttctcaccttagcacacaatctaattgttatgctatgatagttagaggtccttcttatttataaataattttttataacttataagaataaaatttctaattcaaataggtttggaattaatctataacttatcaaaaaaaaagtcttaaaggagaaagaattggtgcctaactaggcgccctcatgcacccacgcctacacccaatgtggggcagcaacaaccaacaccccacctagtcttggtcggccatgaatagagagattttcgataaaaatggactctaaggatctaatccaaatatgggtcaatttgaatctaattcaaatctgattcgaaataatttcaaaaaggctgtcaatcttaaactgcttaggatttaggatcaagtctaacttgaattttttaattcaattaagtttaattaaattaaatctaatttaaaattaattaacacttaaatctaatctctcataaactccttggatcatagatcaaatcttgttcatctctagaattgaacttgaacctcatgtctagtgctagctagtcatagtcaactatttaattctatatgacccatcacgtaattcttaatcaagttaatctatatgttcaatcaaattacgtattttcaaattaaacatataatcataggtcaattctttcctacatcatctgactttgtgaatgagtccataagttcgaacactaagccgatagcatagaaattattttttatactaatcaaagttaccatctagtaatgattttcgatgtccaaatagatcgaataattgtaaggcaatattcaagaacctatgcatatggttaccgcataattcttctctttgaccctaaatgctctagaatgatctagggttaattgtcaaccctgacagagtcatccatattatatttcaaacctttcaaatctatcacatgaattattttagtcaagattttattgaattgaaatatagtgatacatcaactcctataatctaaaggggtcaatcccatcttgatccacatacagactttgtaagtattgactgtacccagtagccttctatactatattagaaatatagatagtccgccaccaaagcatagtaagttatttacaagtcactatggtaatctcagatctgagagacacttatgtccatacgttttgcgagctgctcttgacagcagagcgctcagcaaatgggtcacttgtttagtgatgatgtacttctacatctcatttatatgtcataccagtatctccacaccccttgattaagaggataactaacccatatggcacacaacgatcttcactcgataaacatcatcatcctttaatgatgtatcatttggtcacgaacatgtttaagaactattcgataaatcttcctttatcgattacgtcatacttctaaggactccatcacaacaaaagagtttcataagaaaaatataactttgtgatgaacaatatcagaataacttttatttatcgatcaataattcatatacaaaaagaacacaatcgtccatacgattagttttaggacataattttcaatatcaattcaaagggtacaatgccaatttaaagggtacgatgccaatacaccacattggttggatcagttttgtaatttacttaagtactttttattagatgtatgtcctagaaatcaatctgactgatatatttattatttctaagatataattttatacttgactttattatttattaataagattggataatttatttttattcatattgggtatgtgtccatgaatcattcaagaaattaataagatgatgacatatattctcaagagttgaaaatttaaggcatatgttattagtgactaaattttaaattatttttgatcgatggatcatcatgagaatgatgattgatccgataatattagtgtacagatcacttccttttggatagataagtctcaaatttttggtgtggagatactagaatgagagtgcagataattgttagaaaataaatgtactgagtatgattaatatgaaaagttacttggatgtctactcacttatcaataattttttcgatactgtagtggtgtgactagtctttaacttatagtgtcttggttattcacaatgaggttactatagtttgactatacaaacatttgatccctagccatacgagtttttgcgatacatgttggctgcagtaggttcgttgtaggagtaggatatgcatctagataggatctatcaatcttggtagataaaaagtagttctatgtgatttatgaaactgaattttgaagaccataaccatggcagtgtgaataatgaaaatttttttttcataagatttcataatatgaacttgagttgaataaatctcacgtatgatagatgatagggtttaacgaatttttcataacctcggtcttgtcataactcacgatagaagaactgtatcacataataactacatctaagaggttcattccttccattctgctgggttgccactatatgctgctaggctggtggattgtgagatcaataagaattattttaatggtcaataatttttattaggtgagttgaaaatatttcaatctattgaaaaaagtttcaatgatattagtgatggagatcacaatatatctcaataccaaacagaataaaatctatgggatcacacatataagaggttctaactgatcgagattgttgaattatgatttcaaatcgctgaaggattcgattgtcaatatgattgatgattggattgatttgtaaaagttacaagaaggatttgttaatagttagtgagttaaaaaaatacttatttgtaattattgctacattatttaatgtgatcaaataattgaggttgagtcttagtcaaattaaattaagatttaatttgattgaatttagtctgagtttgaatcagtttgaatttcataagtccaaaaaggtttagactcaaatttagtatttgacttataattgaaatccaaaccaatttggatttgaaccaaccattgaccaagtctaaggaaagatcatgcctcatgagaaatcatgccaaccatattttcattggtggtttttctttcttttgcgtggagttatagggcgaactccttccaaagagtccttgcatcccaagactcttatccctaactctatttgaatttgatttagatatggattaggatgtggcgcctcctcttatctcacgcataaaggagattggcgtgaactaattggcatggaacaaagcaaataaaaagggataggggcatgcgtgaggagttagcgcagacagaaatcagatctggatgtcctttctcttctttctcttgcatgtccaaagtgttggatgttctatcctacacgcctctcttctcccatcatcctcctcctttggtttctctaatatttttttgaaaagaaaaaaatgagaaaaagattcaacaattcaagaagcgatctctgtaagagagctagtatctcgatgagatcaggattttctgatcaaatcagcttcgtgtgaatatctgtaaagaccgaatacacatgcggtttcagagaaacctgcaagacatccacggatcagtaaatcatggtgtacatctatctacgtaaggtaaagattagatcttcctctctacttttatttttattttaatcttgactataaagaatcctagatttttgagatacaatctcatgcatgtatgcatgaattaatctgattttattccactatattttaatttttatgttgcatgctatcagattttcttcaaatggccctcaattttttaactagatctaaagctgcatcattggacctggatacagacttccaagcaaaggccacaacatcattaatagaatcaagagagagccaacttctctcaaatctgaagagaggttttgacttgagttgctcggagaagttgagtagaatcggacagtgatcgaaacaaggattgggcagcgccaattaagatgaagatggacaaatgtcaccccaatcgggagaaatcaaaaatctatcaagtcttgcgaagataggatcatctcttttgttactccaagttctgacctcgaagaggcaaatcaatcagctagagtgaacggatcaatttaaggaaacccaaagtgacaccacgaggctgagggttattgctgcactcaaaaagtcagaatgtagcattgaaatcccctccaatgacccaaggaccagtgaaagagtttcggatggttttcaattcctcccggaagcctctcttcagattatgatctgtaggtccgtagacaaccgtgaagcaccaaaaagtttttaggacattgtcaaaccatgaaatagtgatggagtaggagattacaagttgctgttggataaagaacctgaaactgtcccatccaaggagaataccgccataggtaccagtggcattgagaacaacccaagcatcaatatgaccacccgataaggatctggtcacagaaggggagacagaacccagtttggactcttgcggtccaacaacacagcaatttgaggagatgatagtgtccctaacaattcttcttttaagaggttcacccagaccaattccagcataaaatagacatcagtaaatgagggacaacaaggcacgggaggaatagaggagagaaaaaaaaatccacctagtgggatggaacagaggcaacattggcatgctccgcttccatctataggattagatgaaccactttctctgcatcttgatcggagaataatgccacgttgcttacaccatgacaggatagtctcaggggagagagagagtaaaggtttaggatccactgatacctcaactgcggaggaagaggcatttgaggattgcctgacctcaattttcttccttctagaagacataagttgggtggtgacttctttgacggctagctgggcttttgttcattagcatctcttggttgtctcctgtcgatttgaaggagccaagattgaaggggtggggacgtccgaagaaggggggagtatgttaggagctaagtctggacatggaagttctaaagagtcattagtagggcccgattggagatcttggggtctggcagacagagcctcagcaaggttgtaggatgtctcatcagaagccggagacgggcccgagcagcatcgcatggcctccacctcctcacgcctggagtccatagaagcagttggtgaacaaggaaggggcacaataggactcagcataaggtcggcagaggcgcacagtggatcatccacgtgttgcatcattggtgccaccagatttgaattcaaaatcacctcagattgccagtcaatgtaagcctcaataggttgacatcgagggagactgcgagagagaggattcaagagcttcaaaggaggtcggatggaggagatcagtaaaagggtcataggatctccccttaaggtccctggcgccagaacaagtagaaaaaaggcgacaagaattgactagggaggtgaccccaatagctccatcagtcacatcaccagccaaagtggaagcggaggaataggactgaatctagactcagttctatctgggagaatctgattgagttcaatcaagggccgagttaatgtagagcacgcacctagatcgccgatcggaggaacaagtggacgaggtgagcgggcatatgggctgggagaagccaggttttccccttctgctacctcacgatgggtttcagggatgaagagtgaggggtcactgtgattgtcatcgttgacactcaagccggtgatggagttgaagaggagagaggttaccgctgatgaggaaggagcatcttcaaacccaataattccaccttcatgggataagcgaaatcaccacaggaaacatcaataataaagggaatgaggtttgcatccctgcagaggatcagaacaacgacagattccaaatcacagtcggatagagaggacggagcgatactgtccagcaagctaaagctatagacaatcttacagagtgtctcagctcctctacagaaaatagataggccgaagagcctcaagatagcatgcttcgagagagaggcctggcaccgtcagtgatagaccaaggggagcccaccaagctaaagtgcaaggaggggataggacttttatgaataacctcagcaagcttcttcttgttcggaaaagagacaagaaattgattattaccaaggaatttgggctccccaaagtgatcactagcagcagcttgcagagccctagcaatctgagaactggagaaaggatgacctttgacatttaggacttgaatcattccaaacaaagaggcctccttaatgctattaaggattccgtaatcaggtgggatgtatacctccagatgcttatccctctgttctttctcagaagaaggaccaagaaaggtagaaaaaggagccgccaagcatgtttgagaggagtgtccaactttccaataggaaaaatagatcaggccattgcaacattccttcttgaaatgccctttttcaccacatcgaaagcaagaaccttttttgaaggggacagggacaagaggtcggctatgcttttgaggtatagagatagaagaattaggtttgggatgggaatagagcgcatctttgtaggatttatgagaagtagaaggagcacacccatttgtcagaggatccaaagaggaagggacgcttcgagaggaagcccaagcaggtggaaccattaccaaaatgccatcaaaagaaacaagaggactgaaggaagaagtatatccatgatgctggaaaccaagaggaacagtgttagcccctgtagggaaaggcttaggcacacttgattttctacgaatccagcaccgagactgttggagagcgcctcgaggagatctcttcttccggataccagctctccgcttcatctttgctccaataaatcactctctcttctcgttgaaaatgactttggaccatgtctcgccattgaaactaactttataattacttttacttctaattgggttatacatgctaattcaaatactcatctatatacttcaatgcagaatctaaaaaaaaaaaaaagactaagaaaaaatgaggtgacccatcgagttagcaatgggacaagaattgctgctatagtcatggacacctatcctctgagattaccgtctgggtttaatttgatatttagagactgttactatgtacctgctgctagcaaaaatttgatttttatttcatcattagcataggatgattatatttttaatttcaataaagactactggacgatttattttgaaaacaaatttgttgcacatgattttatgattgacagtctctgtcacttacatatgaatatgtgtgaatatatctgagtaagtagtgagtgccgtaggatctaagagatccagggatgagataaatcaaaagtatatgtagcatctcaagtttgatcatattggagaggatagaataaacaaattaaaaaagcatgggctccttgactcattaaatcctgagtcatatctagtttgtgaatcttgccttcaagaaaagatgatcaaactattctttatgggacataggaagagaaccactaagatacttgtctcggtacatactgatgtatatggtccatttgatgtgcaggtcaaagatggttatctttacttcattatctttaccgatgactattcatagtataggtatgtgtatctaatgaagaataaatctaaagtctttaaaaagttcaaagaatttaaatgtacagtagagaagcaaattaaaaaaattttcaagattcttcgatcaaattgaggaggtaaatatcttagtggcgaatttcgaaattatctcaagaaaaatggcataatctcacaatagatcccttctgatacacctcaacttaacggagtgtcggagaggaagaataggactctattaaatatggtccgatccatgatgagcttcattgatcttttcttatttttttgagaacatactttgcttactgtaatctacatactgaatagagttccctctaaatctattcctatcatgtcgtatgagatgtgatatgataagaaatcgagtcttagtcatcttaagatctggggacatccaacccatgtcaagcgacaataggtggacaagttagaggctaggtctataagagcttattttattggatatcttgaagagtctttaggatactacttttacttctcagaggattataatgtgattgcaagccgacaagctatattcttgaaaaaatagtttatccaagatgaagatagtgaaagaaaaattgagttcgaggaaaaagtctctaaagagcaatgagtcatagaatctatagaatctattcatatcgagctagtacatgtaatacctcctccatctcatagatctagtagaatctttcatcctcttgaaagatatttgaatataattatagaggatgtagagaaaatgttccttatagaagattgaaaacatagagatgatcataaaaactactaccagacgatgtcagacatcgatatcgagaagtggttaaatataatgaagtcagaaattgactccatgcattccaaccaagtctggaccttagtgaatctatcagaatgtatagtatctattggttgcaaatggatctacaaaaggaagataagtttagataaaaaggtagagattataaagcaaagcttgtggcgaaaggttatacaacacgacggtattgactatcagaagactttttcttctgtgatcatgctgagatctattcgcacattacttgctattgcaacatattatgattatgagatatgacagatggatatgaaaactacttttttaaatggatctcataaggaagatatttatatggagcagcctctagatttcactttcagtgctgaagattacaagatctgcaagctgtaaagattcatatatggattaaagcaagtatctcgaagttgaaatactcatttcaacgatgtgatcaaatcatttgattttgtcaagaatgaggaggaactatatatttataagaagatcaatgggagtgcagttatgtttctcgtattgtatgtagatgacatcctcctgattgaaaataatgttttcatactgatttcagttaaaatatggctatctaaagaattctccataaaaaatcttaagaaagcatcctatattctgagaaaaaagatatataaagatagatttaaaaggatactaggtctctcatagaaaatatatatatatgaggtgctgaaaaggttcagcatagaaaactccaagaggagactattatcccttaggcatgaaatacatctctctaagaagatgtatcccaatacatttgagaagattcaatgcatgagcaagatctcttatgcttcggctattgagagcctcatgtatgccatgctatgtatacgacctgatatatcccttattgtgaatattacaattaagcagatatcagtcaaattcagatgaggagtactagacagctatgaaaaatattcttaagtacttgagaaagactaagaatttattcttgatcttcagaggaagatcagaattaaggatagaaagatacactgactcagactttatgtctgatgttgatgatagaaagtctacatcaggatgtgtgtttttgtataatggtggatcgataaattagaagagtttcaagcaattgatcattgtggactctactatagaagctgaatatatcgctgcctcaaaagctataaaagaagccttctggataaaaaattttattacagaacttgatgtcatatcatcagatgccatcacactatatagcgacaacaacggtgctatagctcttgctaaggagcccaggtctcatcaaaagttcaagcatattgagcgctggtatcatatcatacatgactaccttaaaaaaaaatatatcaaggtgcaaagaatagactccatggataatataacagactcactaactaagccacttagctaatagaagattgaagcccatcttgagaagatagggcttagatatatggcagattgactttagtataagtgaaagattattagatgtatgtcctagaagtcaatctggcttacacatttattttttttaggacatagtttttacttgatcttattatttattaataagattcgataatttatttttattcatgttgtatacatgtccatgaatcatttaagaaattaataagatgatgatatatattctcaaaagttaagaatttgaggtatgtattattgataattaatttttaaattactttcgattaatggatcatcatggagatgatgattgatccgattagattgatgtataaattatttttctttagatagatgagtcttgagtctacagtatgggaaactgaagtgagagtgcagatggttgttagagaataaggataccgagtacgactaacataagaagtcatttgaatatctactcactcatcaatgactttcttgatgctgtagtggtataactagttctttaacctgcggtatctcaactattcataatgaagttgttgcagtttgactatacatacacttggtccctagctatagattttttgtggtgtatgttggctgcagtaggttcattgtaggagtaagatatgcttctaaatgagatctatcgatcttggtagttcaggagtagtcctatgtgatttatgaaattgagttctgaagattatggtcatgacaatgtgaaaaatgaaaaataattttttcataagattttacagtatgaattcgagttgaataaatctcacatatgagagatgataggatttgacaagtttttcataacctctatcttatcgaaattcacaatagaagtactgtattatatggtagctatgctgagttgccactatatgctgctaggcatcattagtagattgtgagaccaacaagaattattttgatggtcaataattcttgttaggtgaattagaactgttttaattcattaaaaggagtttcaatgatattagtgatagagatcataatatatctcactaccaaacagaatagaatttataggatcatacacttaagaggttctaactaattgggattgttgaattgtaatttcaaatcaccaaaggatttgattgtcaatatgattgatgattggactgatttataaaagttacaagagaaaacttgctaatagttagtgagttaaagaagggcttatttataattattgctacattatttgatttgatcaaataattggggttgagtcctagtcaatttaaattaggatttaatttgattggatttgatctgagtttgaattagtttggattttataagtccaaaaggatttggactcaagtttcatatttgatttaattattctcagaacccaaaccaattgggatttgaaccaaccattgaccaagtccaaggagagatcatgcctcatgagaaatcacgccaactgtgttttcatcggtggtttttctttcttttgcatggagttagtttggcgcaacaaaaatatgggacgaactccttccaaagagtccttgcatcccaagactcttatccctaaccctattggaatttgatttggatatggattagggtgtggtgcctcctcttatctcatgcataaaggagattggtgtgaactaattggcgtagaacaaggcaaataaaaaggggtaggggcatgggtgaggagttagcgtaaataaaaatcagatctggatgccttctttctcttcctctttctcttgcacatccaaagtattagatgttctaccctacatgcctctcctctcccattctcctcctctggtttctttaatattctcttgagaagagaaaaatgagaaaaaaattcaataattcaaggagcgatctctacaagagagctagcatctcgatgagatcaagatcttttgatcagatcaacctcatgtggatatctgtagaggtcagacacatgtgcggtttcagaggaatcttcaaaatattcatgaatcatcgaatcgtaatgaagatctacccacgcaagatgaaaatcaaaatttcctctctacttttgtttttatcttaatcttaattatgagggatcctagatttttgagatgcgatctcatgcctgcatgtatgatttaatctgatttaatttcactatattttaatttttatgttgcatgctaccagatttctttcactttcgtatgaataaagaaatatccatctcttatttttctggtgagtcaagttttaatcactgaactacccctaatttggattaaagaatagataattgtggccggcatgtgaagcatattatggtacatgaccagctttaattggttaatcagttatatttgagccatcatatgagatctgattagcaattagcatgaaaaaaattatacccaaacattactcttaatattttctctataaataatgggcaaagtgtgcaagcaattctcactggctaacaactgcggattggtctccattgatcctcctaatatgaaaaagcctatcgatgatttggccaggcataaaataaaaacaaccacctttttgtctaaagaaataattttatgtttattatttaaatatattacttttggatttattaaatcctaaatagaaaaaccatcacattgtttcattaaataatagtaatgccgttgtgagatctttaccctcctaatttcaacttctatctcaaccgatcccgccaaaacatggccacctagcagccctctagagttgatcataactcctaacacctccttgatatgaatattttcttgaaaaaaaattatttttttgagagacaaaagaagaaagtcgtacctatactttaaggaggtgtttgattgggggagtggagatgtgaaatcgaaatcagaatggatgacttccattccaatcgtttggttgagaggagtcccattctgattccgattccaagatagaatgagaatagctcaatatatatagaactcaatccctactctcctctatggattcaaattttcattccaatttcaatttcgattctgatcacgaaccaaacattttggagaatttggccattccaattctgatttcaagcccttccgatttccattcacattatgattttgattacgaatcaaacaccccttaattatctaaatttaaaagttattgaaaaaacacccccagaaatggaatatacaaattttggttgataggaaaaaaaagcaaagtagtttgacgattggggcacgacctaattcataatactcatgaaatttacattctacgactatttctaagacaaaacccaaaaaaataattaatgcaaagtagagttaaatataaaaattctaaataaggcattaaaatgtataaagtttatcatcaagttgtaaaaatataacaaaacagcaaatctactttcttgtcattggtaaatcagctttttcaatgataagggcattattattatttgcttaaataatgtcaatatactaatctaggtttagccaacaacaaggattgaattgtcaattgcattgcactaagaaaagaaaacttgattttaaaaagagagggaaagtgtggttgcggagaaaagagggagttcaaacccaactaggagatgttctcgacatacaacttggaacccaattcaactcaaaagattaagccattaaatttaggatccaatcatctatatcaatccacctattttccactaattattgcatttaggactaaacatggatcctcaccgagtttttggttcatgtcccaaaatcaggattaaatcatgaaagttctaaaaaatattaatgtagagaatattgttgctgaggtcatgaaccttccgctaattatatttttatgttcttcactctcattcttctcagaccaaacgaatcagacagattcaaggacaggctgcaaattaaagactatagtaaatatggtaacgcaagtttacaagcttatgcgccggcttataaagaagatgatatgaaaacatcattagattatggaactagactgtcaatctatgtttagattacatacagtccacattccgccgaacaaatcattagccatgatttatctggctcttctcggcatatcctagcatggtgattgatgattgcacatgtctaattattgatgcaagttattataaaattacatatttagctatacatcattatatgtgcgacacggagagaagagaaagggaggaggggaatctctccatacagctatagctcaaacaaggactcctatcaaagtggctgttgagtgggcattaagtagggatgaggggaaagagacatgcgtgcatgacggcagccatgtgtccagaggaatcccgactggagaaccttcgtctgtttcccaccatttccatgctctatttagcactgctaaccgattcttccatgtgctccccaacagacatcccttacttgtttccctttcatgctccatatatctccaccctcatcagctgtgattcctatcaaactacagtactagaaatctatactgccaccactcccattcccaccccaaaacagacggtagagcctctatacgacatgggtttccaaggaaggattcaaggctcctccgaaggccactatcagaggctgcagaatgaagtcgagaaggctgctgtaagacctcgaaggcgatggctgcggaaggtgaagggcaaggtgatatcctttcgcgcatccccttccaagagggtgaaatggatgcggctcgtcgtggtgccgagaaggctcgcagaactatatgccgagattgtgaaaacaatgcgcatggatgaagtctatcctacaatcatcttctcttgccactggggactgccggtgctctctcatcccacgattggctgtaggaagagcgcggtctccctacacccggaaacctctctttctcgtggttgaggtgcatatgtgcatcttttgtaacattcaggatgaattcaatattttctttgatttgtttctatacacttatttccgatggcaatctatctagttagatggttcccacctaggtatattgtaccatatctagtttatagatgactactatatagtgtatcattttccttgatgagtttccacatcgacagcgtgtcttctttttataaattgctctgccaggtttgaactactcccgtcgccttgcgtgctcgaactggttccaagcaaaacttttttttttttgattgcttggttccaaggactaccatgtgtgttttttatacgataggaggggtttcctgtatttcccctgtattaaattttaaactgtcaagccccagcgtagactagtttgtgcaataacttaatagtggttgtaagctgttaccaattttttatttacatcacatccttcagttttcagcagagaccacactgttattgtaacctttcatgtctatcctttgtcccccgttgatcaattatccaacaccccaaaagggctctgccctcgcacactccatcatccaccgctagtagccatcctccccctattgatctcagcctcctcccattctcctatgagctcacacttagtccatcgattcgagccctctcgatctcttttgccactcagctcttccagcaatgctttaggatgcatttcatttgcaactgaaatcaaaatcaaaattaaaacggcgtagattaaaacaagaattggaacaatcatatcccctaatgtgtttagttcatgatagggctgaaagtgggccaggctgggccgggctataccccaacccaagtccgatccgaaaaaaaaatttcgagcttcagatcgggattaagcccaaatattttagaaaacaaggggtccgaaccaagcccaagcccgattgggccaattcgagcccgatcaaggcaagctcttaggtcaccaccagcccgtgccatcctttctcccccgctgatcacccccataccctaatcctctgatccatcgacctcgcaaagatcgtcccgtcgtcagtgatgacgatggcattcacggcgtcctcatgcgccgctgcagattcgatgcaacgaaggttggaggtgcaccagatcttgagggttttatcttaggagatggagtagagcaggccaccggaggtggtgatggcggagacggtgtcggcgtgttggatccagaggagcttcttgtagcagtggatagtgatatagttggaggggagggggaggtggtggagacagtcgatggcggtagagagggaggcgaggaggtggtagcggtcgtagcactttcaggtgtggatgcggccatcctgatgggcggtgaaggcacaaccatcaagagagaaggtgacggacttgatggagccagcggtaggggcagcagggaagaagtcgaggtggtggagggagacgaggtcatatatggagatctcaacagtggaggcagagtagaggagggagggtcctgcaatgatgatggcggcgggtgcttcgtcgggggtggggagggagaagaggtagacaaaggaggcggaagagggaggggagtctagaagggaggaggcgagggattggagggaggggagggtgatgtgggaggcggagtcgatggtgaaggaggtggcggcggtgccattggaggagctgtattcgagaacggtggacaaggaaaggtgtaggatccgagacggcagagtaagaggggcggttgggtcagcagtggtggtttggtggaggaggtatttaggagtcggacctgcgccgggccaaagataagctcgagtccaatccgaaagatagaccaaccctatatttagacccacatccgatctgaactatttcggaccgagtctgaagttcgatccaaagtcagcctgatttaatgggcctcggaccggtccaagcctagttccagccctaattcatgaccataatcaaaaagagatttgaatactatgggagaatgattagattaaattttgaagaattaggatgttctcatccccctggaattggaaagagagttcctccaataaaatggctgacatgagaatcacttattaacattcctatttcagagtctaactccccttaaacaaacatgcccttagtttcttcgtaaccctagtaactctttttagtccatgcttctccaattcctctaaattatgtcttgctcgtagcaatcattggctatgaaactagcaaaatagatattcttatcgccactaaaataaaaatattgatcgatatttttatgaaaatactgataattaattgatgacactatcttaaaacagtacataagaaaataccacaaaaatattgataaagatatttatggcattttttctgacatatagcagcacttaaaaatacaggtaatggtaatttttgttatagtgttaagaatttcacaaaagtttgaccaataggctggtatagattataaggtgaattctattcttaacacttttcgcaatttcttagttccactattttggagaactttgaaaattagatcacatgcttctttaggaattatagtacttagcagacattgattagctttacatcaagaaatctagttcgtctcaacattgaagatcattggcccaatttgccaaggggtagctcgaatactgaagaatactaatacttgagctattaattgacaaattatattgagaaagacatgcagaaaaggcagacaaaaagccatgattattaatttttactaatacaattacataaatacaagatcaaatgggttagtactttcaaggtgcccacttcattctaatctaagctaatgcagtttttcaccatcaatggcttattggggtttaagtctgctcactatacatcatcatcaattgtagtggagatagactgagtgtagcgagattagagcttaggtatggatctagttgatagaagaagccatgcagagggatccacttgaaccaacttgaagatggtgatggaacactatagccaaaagcatgctggcacttgctgacttagaagccttgaaccaagaagcaagatgctgtgatggtattctaattcgatgacatcaccagttcgtgaagacatttcgatttctgatagtattccaatttaataaaccagttgggagttggttggtcaaaacaaactagttgccagccaatactcagggtcacttactaccataagggaaagaagaatagagaaaggcataaagctggctaggaagaagaagaatgagtgccagagataaggatacaaggcctatagagtcgaagaattccttttcaacaagtaaaccaaaatccttattaatacagaaaataatatcaaatcctaatggatttggaggatgcttcgagtagcgcaggccgttttggtatccaaaagcatttcacatagagggacatggtaggagagaaaggcttagtggaatcagaagagatacaagcgaattgccgaaggtaaatattttgataaaaggacaatccttagtccgtggattaaaactataattataggattttaattctatgggtatcaaggaggtgatgatggacaacccattggcctcatgatccttggctagcgagatattgagggcattgttcacactatatctcaacaatctatgtggcgatcaggagcaagtaccatatggattaagttgatcaaatcaaaataagaatcctgtctcttgttaaccttagatagtgttcactgtgaaaatcatgcacatggtagagatccaagctgaacaagtagaatttggtcattagtaggttaaaaggtcaagtcttgctgtgaaagatggccggaagaagactgaaatgatcgtaccaatctcaaacttcaaaaagtagaggattcccttataggccgaataaagagagatggttaacataagctatgtcaggatgacttgaaggctgataaagcataactattaatttgatagttacagaatgatcatgtttgtgcatgatggaaagacatttaacaacaactatcaaaacttctagaagtggagattagacataaagagcaatcaatggaatgagttatagtgtttgtggatagttattagggctggaactgagctcggaccgatctaagacccatcggatcgacccgacttcagatcgaacttcgagctagatctgaaatagttcaagttaggcttgtgcttgattataaggcttgtttgtcgtttgggtctggctcagatatatttttggtctagctcgagtctgattcggatctatatccaagtttgaagtccagtccgatcaagagcccgaatgttcggcccaaacccaattcccaaaattattttttcttgatgtctgaactctaaaaatgctaattagagcaaaaacttagaattgtcatattaattaaagcaaaaacataggattatcaaattaattaaaatggattagaggaaaatgtaatgagaaaggggaataagactttttcttgtgactcttcgagaaccttctccctttgggcctcctccccctccattacctttcatgtggcggcggcctccaaccaaaggctcttccactcttcaaacaccttcctcttcctctccatgatctcaacttcctcctgctcgcttacttggatccttagctgctcctcttgatcattagaccatgcctttttctcctccgtcggtgacacagtgctcgtgggtgggtgtaaaatgtgatggtggccgcattattgagatccacctcccagccactcatctcatgggccagatccccatcagaacccttggcaacctcaccgctctccaggtggttagcctctgccttaacgccctctccgatcctctctcgtcaaaccttgttggctgtaaggagctccagattgtctatctctaggggaatcacttctccgacaagatccctgccggcccattctccctcaacaggttggttctactcagtcttgtcatcaataacttcactagctggatctcgtctggttcaacaaccttacctatctcgagatactctacctcaagcacaacctcctcatcatcctctactgaaggggaggagggagcaagcgggcaacaaagacagaggtgccaaggaagtcgatggagtcagagatggattatctgcagaaatcttgattgaattgttccaatcggattcggactgagcatgggcctaggcccggatcaggttcaggtttgagttttttaaaaactttcaaatctaaatcccgcctaaagtcctaaaaaaaagtttcaggccaggctcaaccaagggtgtggctcgacccggcccaacccacttccaaccataatagatactatatatcggtatagataagtaaaattgtactctaaaaaaatttttaaataattaatcaaattagtttatctctacctttatcttagttatttgtcttagaagtaaatgtaacttattttttttatcatagtataatgccatatccttctactatagcctagtgctatactcatttccattgttatctccttcaaatggtggtgtgacggtagtaaaaattctgaaaaatcaaattatcttaatccatgctgctctttatctttcattctgccaacatcttttcaattagcccaatgtgatggcacatccgcacatatattcatgttttgcttagttaagcttggcggactatcccctaccctaaccaattgagctctttagagatctcaagttctttgattcattcggaacgtgatggaaaaagtggcaacctttctcctcttccatactctaaagtagaggatgaaatattagactcttgaaacttcatcttgtaatttgaattttgtggctaaattttccaatctatgaattttttttaaatttataatttttcattaggatttctatccttctcaaattctccaagagtcctggcctgaaactaggactggctgtcctgcacgtatgaaagtcaagcttacactttgtagcatattttgagtgactaaatttattccagaccataagcatccccttgcagacccattaatggctcgcagattgagatcacattgggcgaagtctaaaggtaagactgaagctaccaataatcaccagtcgaggcacatgtagatgggtgatgcaggagctgcatatcagagaatgcaagttgggaacccattcttcttttatgcagtatagatagggctgagcaaataatcaaaacttaaaaaaatccatctaatctgatccaataaacatcggtttcaatcagttgaaagatataaattagatagaatcggattgatatttgtaaaaaatcgattatttacggtcggattcgattcttacatttttaacccatatgagacaaaatgcaactgatgtagtatttcacaaactcactttcatttttgggacagcatcatttagacttcaatactttattttaaaaaaatcttatcacctatttggattcatcagaatattaatattgaattattgatgaaaacacatcaatttgagataattctaaaatgaaagctctcagatgtagttattttcagatgaataaatcttttctatttttgttttattttgtatagattcaaaaataaatctaaaatttgtaacttataagatttaggtttttttttatattaaattgataaaaaaataaataagcttaagtaagtcaatattagacttaagatcaatattggatcaatatcgaagaccaaattgatataacgaatcgttcattttgatttcaaatgatttatatatgataaatggtaggcaatgaattaaattttctgtaatttatttgaaattgattggataaaatttttttcttagcacgattgaactcgatccatgctcaatcctaaatacggatcggcaagctggtaacatggtcaactttttctaggccgatgacaagtccacgatggagtacatttactttggcgttgtagtatgcttggacagaacttacaaagcaaatgattatggcaggtcgttggctttattcgttggcgtgaataatcataagcagatgcatggttgtctttggttctgtattgcttgatgatgaaagtggagaatcactcaagtggctgtttgggatttttaagaatgcaatgcgtggcaaacaaccgaaaacgattctgacagatagatgtgaagaaatgtctgctgcagtagctatggtgtggctgggcattgtgcatcgtgtttgtgcgtggcatgtgtaccaaaagctaaaacacctaaataaggtctttcagggttcaaaaagtttcttaggtgatctgagtcgatgcttactcaattatgaagaagcggaggaattcatatcagcatggaaaaagatgatagagaagtatgatcttagtgacaatgaattgctggctaagctatatatataatgatcgggaaaattgggctgtgccttatggaagacaggcattttctgctgacatgttcagcactatacggaaagagaacccagttagtgcatataaaaaggtttttagttcagaacaagatcttttctgttttcttgtgcattacgacaaattattggttgagctaaggtgtacagagttgcaagctgatcttcatgctagtcagaataacttgaaaccgccttctttgtgcatgttgaggcaagctataaatgcatatacacctgcagtcttcaaaatgtttcaaagagagcttgaaatgcacgtggattgtacatatggcatattattttggtgaagctgggactatattagagtataaggtgacagctgacgagaaatccgttgagcatatcgttagatgggactcagcagattgttcagtttgcttagttggaaaaaatttgaatttgttgggattcaatgtcgtcatgttttgaaactatttgattacagaaatatcaaagaacttccaccacggtgcatcttgaaacggtggagaaaagatgccaaagtttggagccattaaggacaatcaggaatatacatatgatggtaattcaaagttgtttgcagcaaaccacgttagttatttgtttcgcatgttcagtatgattgcagcaagggccgcaaagatgatggaggcatataaattcattgaaagccaatctgatctgcttatggaacaaataaaagcacattttgcagaaaataggctctcctgagaaatgacacctgattttctcttgagcaaacaacaatagatcctgtttgacatgcaaagatctatgtaattatttacgaccctcatggaatcacaaccaactacatatttgaaaactacctttacaatgcagaactgtcattcttcctccacaatatacactgaaaaagaacatagttctcttcttgattcggaattctaaagagtcccaacttcaacgggactgggactcctcatctataaaaaagctcaagaccccaggtatgaagatggaaaacaagctctctacttcccgttctactttgtttgttctacatctcctattccctagagtcttgtctaacttaagtattgaaagatctctatctggatcatcatccggcatagtggtttgatcaacgccctctacatcttcagatcatcagactgggttttggtgacaataactttgacatacaagacccttgccaacacctaaaactcaatgcatgatgttaaacgggatgttgaccaccccaatatccactgaacttgtaatcatagatccttagaatccgccaaggtacctagaatttacctaggtctgcatggtgtccatgatgcaaaggaaaattaagggtaatcatgagttcatttatactcgagaaaactttcattaacttccggtattaaaattgagtgcataggagggcatttacaggcttggaggcctcttacaataatagggatggacggatagctcgcccaggtgcatttctaaagaaaaattcactttgatgagagattattgtcaaattggtttggatggtcgtcatgtcaccatcaagttgcttctaatagtggtacaagagccatttgattccacaattccttggttggcttggacttagatgccacatctttgggtggcgatcttggcacagtcaaatggtgtatgatttcacctctagaccagattaagttggcctcaaatttgattgctttggtgcacttttggaagcccttagccagatgcttttgatcgtgaaggcccttttgatggtgagtttttgctgtcagatgtcttcaacgacatccagcgtgctatcagatgatggattcaaccaaatgcctaagcatgcagtcctggcctgcattactcattaccggtacatttattttatacaaacatagccatccaaaaacccatttagactttcattgatcataattttaactaaaagatgatataaaaaaaagcaagtaatatttacttgttgtgttaatgtagtgattggatggagctagtcccttctcttttctcaaaaaataaaataaaataaaataatgcacaaaaaatagaatcaattttaacttcaaatctatcatcagaatgacaatagacttaaaagtttagaatagatgacaatcatcagctaattaatgataaaactaacttaaatgcagtctcataccccaaagtctgtcaatttttgtatgatgtctggaagttttgattggatcaccttggttgggccatcaagtccagggctaaatctaaatccacctgtttataattagactgatttgggaaagacccacccaaaactatttactttggatggaaatgtgcaggttggtgagttattttggatgaattccaaactcgtcgataactgtcgaacttgctgttgaaattcatttcttaaattcctttcttcatttattcggttcctagtggaatggaaatgatctggtgcgtgctaatgtgctccactcaaattctggaaacatgaattgtaaagaaattttatgttgctaagaaattttacgttgcaaaatcatctcgcagactactctagaactgagtacataataaccagtactgatcgcctagatgcttctgcttgctgttgaaattcgtttctgtatttctatatgatattagtgaacaatattttttttggtatcatattagtgaataataattgtaaacattgttgttggtcgtacccttttaaaaaatgtgacatggttattgaattttatatttattatctatttttaaccactgaccgatgatggattccacgcggaagcagcgcatgatccaatgagagtcaaagcaatacaccgccacccgtctcatgaacgtctttatactaggagctgatgtgtggccaaggaaagtccataggatttttcttggtacatggtacagtttatgccgctccagcggatagctagttgtgtaggactgttgtgcctgcactttttttattttttaattatttttaataataatttatttttaatataatggatgggttgacaaaaaggtagataggaaaaaaaatggatgacggaaaggatcggttccgcccatccccttatatgtttgataaaatataaaaaaataaatttaaataatttttttatttgatataaaaaatgatagaaaaagttaatgatatttatagatatttttattaaactattatctaataaaaatattattataattaatttataatatttatttatattaaagaaatggagcaataatatgaaaattataatttttataatttataataaaataaatattcaatttaatttaataaataatttataaactaattaatttataatttaaataattattaatttacacaaaagttgactaaaaataataaaaaaatagaaaataattttaattatcaacttataattatgaaaataatgtgataaaattaaaaatattattaataaaaagttaacaatatagagtaaatagagataaatatatatatatatatatatatatatatataattaataaaaaatattatgattttgttaaaaaaaattaataaaaatntttttatcaatataaaaaatttatctctcatatgtttcatttattcttctttatattctttctgtttccaagattataaaacaatggatttggataggtagattttttttatgttttaaattttttttttggatcaaataagaccatccatccttatccaatcaaatacaggattaacgcgaagatggaaaagagtggataactgtgggtcataaaatactcatcctgaacggacggatggcccgatggttgcaaaagatggcaggaatcccccgtttgcgcccgtgccttccccactaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccatcttttctatatgtgcaacgctcctgtccgtttccgtcctggaccgtaatcgctaggtatttccaaacaccgtgcaaagatagattagggtttcccaaccccatcccaattccatccattcgacgggagataagatgtcgtcggacagcggcgtggtgacggtgtacggggagaccaacggggggtcggcgctgacggagctgggggtgaagaagacgtcaacgttctcggtgaaggtagggctggcgcagatgctgcggggcggggtgatcatggacgtggtgaacccggaccaggcgcgtgtggcggaggaggccggggcgtgcgcggtgatggccctggagcgcgtcccggctgacatccgggccgggggcggagtggcccggatgagtgacccggggctaatcaaggagatcaagcgtgcggtgaccatccccgtaatggccaaggcccgcatcgggcacttcgtggaggcccagatcctggaggccatcggcgtggactacgtggacgagagcgaggtgctgaccccggccgacgacgcccaccatatcaacaagcacaacttccgcgtccccttcgtgtgcggctgccgcgacctcggcgaggccctccgccgcatccgcgagggcgctgccatgatccgcaccaagggcgaggcgggcaccggcaacatcgtcgaggccgtccgtcacgtccgctccgtcatgggcgatatccgctccctccataacatggacgacgacgaggtcttcgccttcgccaagtgcatcgcggccccctacgacctcgtcatgcagaccaagcagctcggccgcctccctgtcgtccacttcgccgccggtggcgtcgccacccccgccgacgccgcccttatgatgcagctcggctgcgacggcgtctttgtcggctctggcatcttcaagagcggtgaccccgcccggcgcgcccgcgccatcgtccaggccgtcacccactacagcgaccctgacatcttggccgaggtctcctgtggcctcggagaggccatggtcgggatcaacctcaacggcgacgccaaggtcgagaggttcgccgcccgctctgaataataatacacatgttattagacagactgcaggcaggcagttcgttcgacttcgatcgatggtatgattatggtgacggctcagctcagcgctgctcaactcttgcccatttgccttctctctatgccatgattttgacatgcttttcgtttttttttcttttccatttttcctaggtattatgtcaataaagttacaatctactcttgtagcagctacagctaaaaacattgccttttctttttcttccatactggcctgtctgtctgtgtctttcatgtgataaaaccctctgctgaaaagaaaaccaagctggatcgagatttgataatttcaaaacaaattcaagaactacaacctcaaattcaaaaatgtgaaatttgaattctaattctctcagatgattgacaagaaaaccgagctggatcaagatttgaaaattctgattatttcaagtgatggttacggaaactgaactggatgaagatttgacgattcaaaaattaaatccaacaaattcaaaatttcaattctgattctctcatatattttccacgaggtggacttcacatgatagcagctctaaatcatcctattttgcatacatgatattctaaagttcacgatatttatagttttatgcgtaagcctttcttttttcaggatgattatataaaactgcactgcgtgttaatagctggcaaacttgtccatgacccttctcatgcactgtccgtgagatccataagggactgcttggaacgctgcattactaccctgtttgggtactccgttttggaatatggagcaacatatactcaaagatacgataacataacctatcacattattggttgaatcaaagatacgataacataacctagtgtttggatgtgcaatcatgagtacagcaggatattggataagtagccagtgtgttgttattaacattactatctggatctaaaattatttcaagcaaatctcttcaagttttcaccttttagtaacagaacctacctgggccagaggatacatttggataccacatctacacatacccagcatatacccagacctactacgcgcacttgcagtacactgcatgaactatacgttacaaagccataataccaaaaaaatgtaggatgaggtctatagccaatattaaagcagcaacctactacaacaattgctctagaagaacaataatactaagaaatcaagcaataatactaagaaatgaagcaacaagaaaaaagaaaaaaaaacagatgggatttggtctggtgactgaataattagaaatgagatctcgaaaactaatagcaagaaacttgtctactaaattttagttacatgactgttattataatcacctctatattcaggttacaacaaacccaaaaaggtagcaaaagcaccataacaagctccaaattatttaacacattggtgtttattatgttaccactgaagacatatctcttcatgcttcacataaattaggtgtccaattagggttcttaatgcaggtagagaaagaagaagagacccagcacgactatagcaagaagacttgttcgatttgttcatgccgccatattcctgcaagtctgggtatgttttgatgaggttaaggtagagcatgcaacaaaaattacatatggatggacttctttcctgttataagaaaattccagataatccactgaaaaaaacaaagatgaataattcaagacagaaattttgaaggtacaaactccacgtaaaaccaagctcattgcaattcaggtgcgcaggaggctcggcgattaataatgtcatagaaacagagcttaaaggtaatactgggactggattgaggccttgcaacaacccaaaatctcttgattacaatcttctttgaattgaagtgtatctttgatacagtggattgaggcaaaatagttcaagtttgggtttgaaaaggatggggagaaaaaaagaaaaaatgaaagtgcaactatcttttattttcccaactctcgtctttgttggattctctccattaaattttcatcatattgaagaacaagtgtgtgctgcccaccatattgaatgacaagcatgccgctttctcctacagcatatatacctttgactgaaaaacattattttcactgctccatatcattgttacttttcatattaccacaagaaaaacaattgaactgtcccaggggaagtttcagaagataccaatattatttgaaacaggttggagattttcattggtctttatgctgatagaagaattaaaaagagatctaattttgatctccgagtaaaaaacttataacttacactacttgtcactccatagattaaaatcaaagttcaaaaaaaagtaaacatttaaactacttgctagttaagacatcgcaatgttacttgataaattttatgttaaactaaaagttccaagggacatttgattcataaccggaattagaatcggaatgagaatcagaatcggaatggccaaatcccttgaagcatttgatttgtggtcagaatcggaatacaaaattgaatctttaagagaaaatagagattgaattttagagagattcgaccatttccattccatctctgaatcagaatggggctttttccaaccaaatggttggaatgaaaattatctattcttattccacttccagatcttaactctctcccactgagttaaatttttaaaactaaaaaaagtagtacctttgtttggtgagttctctttagcaccaagaataggaaataatatactttagtgaaatcaaagcctttcacgtactgtaagaatttgatccctctggaattggacatcaccaatgaaattgtcataagaaaagggagagattaggataggctaaacttttgtgaaccttctaggatatattatttccttctccacttctccatttccttttatacaaaagcacttatgcactaaattgcttccggcaatactcaagttagagagagccaccaataactttatttagcacacaccaaaggggagattgtaacttctttattgggaaccatatggttttagcaaaaagagatagatgaggggagtctatttacaaatctacatagtcaactagatcatttgtataactagagatgtggattgctaaacttgtcagcaaatatataagttcgatggttgatttcaaagtccttcaagatcgacaccaaatattttctatctcttcatcattcaaaggtgcaaagattaggaaccaacatagacctgatagcaagcggagattgatctagtgctctaatatatttcaaccttatgctctacaattaagaaaactaaaatagtgatcgaagaacatcacatagtagtagtcaaaatgagtgtatagggttttaggagtttaagatttagggttttagggcttaggatttgggaatttagggttttagggtttagaatttgagatttaggaattgggatttagaattttagggttttggattttaggggtttaaattttaaggtttgagatttaggatttaggatttagagtttaggatttggggtttaagattctgaattttggaattttggatttagggtttggggtttaggattttcggtttagggcttaggatttggggtttagggttttaggctttagtgtttgggatttaggaattagggtttggggtttagggtgtggggttttaggatttaggatttaggattttgggtttcgcatttatgatttagggtttcagatttagtgtttggggtttaggaattaggatttaggatttgggatttggaatttagggtttagggttttaggattaggcttttagggtttagggtttgggatttagggttttaggatttatgattttagattttagggtttcgagtttagggctttagggtttagggtttagggtttaggattctgggtttagggttttaggttttaggatttaagatttagggtttagggcttagggtttagggcttatgattttgaatttagggtatataatttaaggcttagggtttaggactttggggttaggattttggatttcgtgtttagggtttagggttttagtgtttagggtttagggttttagggtttagggtttggggtttagggtttaggggttttag

SEQ ID NO: 28 - DNA, 15323 bp, Elaeis guineensis
  misc_feature (2495)..(2678): n = a, t, c or g
gtgaagtttagatactacctgggtagcactatcatcaagctgccatgcattgcactcattttaaattgagatgactcaaatgagtgctatgtgtctccaaaattatagatttacaactattaattaatgtttttaaattttaacaaatacgtgccaacaatcaaagtaacacatgtccaatgggagtatttggacaggggttagcatcatctggctgcctgcatgtaagtcaatatgtatttaatttctaactatgaacaacttaatagactcaattgttatggttttcgtggcaaagctgcagacgacatgggcagacattatttttgctagactaaagagcagagagacgattgacggggattccatcatggtggtagcctgattacataaacaattatcatcagcagcagcgcatcttctcattcatgatagtcagtgtcagggagctgcttttctattgagattcgttatatttatcgagaggtcaatagctctactgactggatgatcttttatgtgactgagcatatcggagagacggtgtggactaagatcaaagatcttccttcgaccttcaagaatatttattttttaattttttttggatgtattcgtatgaataatctagcctatcaaaaaaaataaagtgacatgtggcctggcacaaagtcacgtgaccttgaattccaacaagcattttagattataagcttacaccatgggcgagggaagttttccacattttcttgctacttctagacgcttggcatacacttacatgtctaaccaaatctcatagtaacagcaaattgcttgaaatacagattgctctatgtcaaattctttaggctgcagtgagaaaggagataggcgaaactgaagaaggggtggaaaatctaaagttccataccaccagttcatgcaaacatcactggttggtcagctgacctctaacaagaaagactattcacatggagggatgacccactgatgccccaaaacaataatgcaaacaaagagagggtcgctctctcacttgagcagcgtagggatgccagtgagtgcaataaagaagtggggacgaggtattagaatttcgatacatgtgtgcgtgtgtgagtatcacagagagagagagagagagagagagagagagagattgcatgaaagtcctcagagtatgggacatctccaaaaccaagtccaatatctagtgatgggctcttttatacaaagagtgatgcgcaagaaatagaagacatggaggtgagaagcttgatccatgcatgcatgaacatgatgtgagagagaccatgaagctgaagaaaggtccatagccacagaggcaataaaagaacatggttgggatgttaaatcacagtaaatggtgaaaagaacatggtgcaactataaggggaactagttttagtagttcatctttttaggaccacaccgcaaggtggacagttggtgttacatttagtctctcttcattctcttttaagggaaaatgtcatctagagtttgcagaagttttgaagttttacaatatcgcttaatttaattcaattgatgaacaataatatttagtgattgaaggtgtgaactgtaaggtcacttgaaatttagagtctatacacattgggagttcaaaatatctggtcaattttattaaaatgtattgttccaatattaaaattttctcgagttttctttaaaggactctagtgttcctttgatctaaaaacagtctaattttttgctaccacaaatatactacagtagaggcaaaaaaatctagataacacaaaggaacaaacaactttatgtttttaagcaagcaaataagtacatattcttccaacgttttctccaagaacatgatcaatagttcaaaatgtttgtcccttgatattctttacagaaaaaactcacggacaataagcttaaatcttcatggccagtatattttgtaatatatggtgaaactggagttcagttgttctacaatcctaataagatcataggggtgcaattcttgtgtccttacacttagggaaaaagctttatgccccagctagaaagattatatcgatggtcccggaggagtcttgatttagtacataacttctaaatgtggagcatcgcccaggaaggaaatatatccatattaacaaagtttgcaacatttggattggatgatagtccaatgaagaaaaattgacctactcaaccatgacaatggagctgtcctcctaacatgataaggacatagcaaccatactttggtgacattttaaaatcatgcaattacttcatcatgtttaccatggaaaattacacaagaagatggaaaacatagcatagcatttaccataaagaaccatgcatcgttacgtcatccaagcgattcaggtgcatgcatgtagattttcctctctttgatctatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatctaacttaataacgaagtcttatgtatgctaagttttccctttagaatacttggaaggcttgacagcatgcaatcattcaatcaaaacaagagagataatagattgtttcagagctaggcttttggaacaagtaaatatagtaatacaaatagacaatacaaaagacaacatttttgtttccagaaaaccattatagaattttctaagcctttcccttctaatgaggaacatgttcattgcaatgttagagctatatgactaacttgtataacggacatgccacgttagccttgagtgatcttgaaattgttgaattagtccaacaaatacgactatttgctgacgcctagcccaaataaaacagaattaacatgcagtctagtctgaattagtggcttccactaaggattagaatgtttctcctaactatagagcaagaagacctcttgtatttagcaatgttatccaagctggtcgttattattcctctagaattggctcccactgatcagctaccaaagttagtccacagcacatagtcccaaacatgtcattaggtttaccataaatttagtatttcttggtaaatagaggcaaacttgctgactgttcatgcaattaagttaccttgacatatgtgatgcattaattacatgcaaagaaaccatctatcatttggagcttatactggaaattgaatttcccgagagaatctatatattcatattcgttcatccctcgattgtattttcaagaaaagatttgaattttaggcaacatacctttttctctattggtcttaattttttacatttccaactacttaatgatatgattcagatacatagggtttctacccatttttcttgaaaagaaaagaaggaaaggaaaatccaatagaatttacagtgcattgttgaatctgcctaatctgaaccatgactttaaaaaaaaaaaaaagaagaagaagaagtttctggctacatttttatatcagcttataattagtttttattaatagtactcaccaggaaaagtgtaaatattaattgttcttatgtattattgcttttcttagtgtttttctgttaggaaaacaaaagaaacttgaaattgcactaactacaagtataaaaatgaaaaaaggtaaggccaatgttagagagcactaaggcttcatggtataaccttcaaaagttgtgatggatacaataccataggtatttgttcttgctagccataaaaatatacaagcatatgagggtagcacatggtaagtagacacaaggtatatttatcttcatgatatcactacaataacctgatgatatggtgatgatgttatccataaccttatcaataatttggttttgattttctacaaacagggatgtgtttttattctttttgaatatatatatatatatatatatatatatatatataaagaaaaaaaaccttggcaccggtagggcatcatgttaattaacagacatgataatgtagtactaaaagctacatctaatataattgtacttttactaacttgatgtgaaacttaaaattgtattgcttgggatcaccactttatgttgcaccacttttgtgtgttcttgagcatatctgcgcatatcctctttcactcgcattatttagatattaagtgcaaacatttaagaaccagttatccttgaaagacatttgagactgcatgaatgccatcagatttcttggccaatggaatgaagcaggaatggatgtaatgtgatgtacgtgggtagaagggacagcgttaacatgaaacatgtggaagttttaatattttgagaagagatacatgcaagttacaaaaaaaattaaaaaagaacatacaaaaaaaaactatttatagatgaaagaaatgaaaagaaagaaaaactttaaaagaaagaaaaaaaactttaaaatacaccgcaacgattaatttcttattcaccatgtcacctcttctatgaataacgaatcaagaaaagatctgtggcaggtattgccaagccaagcttcaataaggttttgttacttctagaatccaaactcccttgacctcatagttatgcgagagtctagtctattcattacttaattcccccacctaaccctaatctgagaaggaattattatggcttggggagatcacgtgcggaggaggcgccaccgatcgttttcactttaccgcgcgcttttcagtcctagcagtgcccccccagtccccaccacttccctgtcaactgctccaccgcaacctctcaatctcctaacaatcactccaataacgacaaaatgatggagctaacccatgacattttatatcgaagatatagtagcacaaactccatccggcggtacagcttacccagccaacccaccctccactctttaagaggaaacccacatatccgatgccaattgcatgcagtggaaagagagagagagagagagcgctgagctcccttcttttccctcggaatttgcggtgttggacttcaccttctcttccggcgtggaagctgagttcccggagtggtagttttttccttttttttttttttgagaacaatttctgtctttctttctttctttgttgtttcggcttttttgatatttgtttcctttcttgaggaatagtttttatgataataccggaattgggggttgctagaaatcgtgaggtgtcattgttataggttttttttttttgctggatcttcggcgatctttttgctgatattatccgtttttaacgatcggaacgttggttgcgtcaccaacaaaatgcgactttgttctcgcttctcgctagatttgctccacgaaaacagtagctttgtcggatcggatcgtttgctccatgtctagtttttagggttatcttttcacatgttcttgaatatatctttgtcaagaaaaaaaaaaaaaactttaccttttgttctataacaaaaatcttttcttccacgtattttggttgccctagttttttcttttttttgtttgtttgtatttgttagagaatcgagatttgagccgtacatctcgttcataaactgtttcatttgtcagaatttaaagaaactaaacttcacgtatgcatcgttatccatttgtcatgatcttgtctcatgaatatatgtattctgttcttgtcttcgccttaatttttttctcactttcttttccgaaccctaacccattcaaagttcccaccttttctctcttacttgctttcatgtttttttcctttttttttttgttgcttttaattttgcttgaataccttttgatctatggaaattaataagtcaatatgtcagtatgtgaaggtctaggccatgttagtcccatcatttcatttatagtttagatgatgattttttctttgttcttggcaatattctagaccaacttcagcagacagaggtgaaagagagatcatgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttttgctcctcttcaatttatttgcttcccttttatccctgatccaaatggtttttttcttatttaaaattaccctttcaaattatcacatttaattcagcttttattattattattattgctatgagattagtttgttgttaagattctatataggaaggaatgatcaagtgatcattactttatgtagtaagaaattaacaagcaaaagcagcgtgcttggtcttaccatgaggatagaggaagagttttaccttgactagggcaactaaaaagggtttgagttttgcctaacattcttgttatatgaattcgatctgtacacgacttactactctggtattagaacgtatgtactaagaagttttcttgggatggaaagaaagaaatagtgaagtaaatcttattaatttgtctttacatgttcttctcatattttctcatactcttttcttatgttcagacttacaccgaaaaattaagatggatgatattatgttcttggtataggatttcttttccgacgtaccaatgttttgttaaggaaactttgtagttgacttttcgattataatattttccaaaggactccacgaaatggtaacatctccagtcgtttcaataaacttccgatcatattatgggtttgcatttaaggttttcttcttcccttcgcttcctctttgcctttgcctttctcgtgttacacttctggctcgtcaatctgcagtactctctagccatctctctctctctccatccacccaccccccccccccccaaacaacacacacaccctcccaccctgtgcaactaattccgacaaaataagggtctcccattgttagagcacctcctgtatggactgcattctaaagatacgggaaaatgagccagatatctattcatcaatcatttagtagagtctctaaggttcctttttaaaactgtcttgaaccggcttttgcacaaagagcaccactccctttatttataagttgaaccttcctgaaagctaacttgggtttcagctttcactgttcaagtaagtcataaagtttttctggtcattaaaccttgtgatatggagatggaaactgcttttctccctgccggatttctcttctggtgctaagcggctaaaacccatcatccatgtctgccttcctcttttatgggtagttgctggacttcggacaccggtgaaggatgaaggctctttgtgattggttatgagatatttcttgggccccgtgcctttgctgtcattccccacaactcggtggccatcatagcttttttgttagctttcgtccttacaaattcctctctggttctttctttcaccttttcatgcatttagcttcattgtcaacatcaagggaacacagaccggaagaagagcaagaagaacccaatcaagactggattttacaaatcaccaaaaaaaaaaaaagactggattttactcgacgacgctgcagtcttctctgctctcactcaattaaaataggaacaaggaaaatgtagatattttttcccttttcgttatgataattataatctaagaaagattttaaaagcttactgtaatcatctcatgttcaactattgtgttgcacccaacgaaatttctgtgtgcctcatgacgagcattacctttccatggttctgacacgacattgcatactagattttactgtgtacgtaaaaaagcactgcatgacatcatctctattcttcttcttcattccctttttttttttttttggtaatatctattcttctttaatgtcctctctgataactggtcttatgtacaggtacatctttacaagccttccgagagaatatgaatgcgtattttctgcaaccgagtatattctacaaataaaatgttagagattgtctcgaactggtatacaagcacattcctgtacgtgttgacatgaaagaagcatagatcagacaaaaataatagtacgtgacaaagatcataaagggactacaacattaggagggctacaattaataataacaacgggagcaactagcagtgtatacggttcagaccagatcagtttagagttatttttggaaccgagctgacttagttgtttttctaaagcctaaattgaaagagaaaccgattcaacctgatccgaaatactcgatttggtttcattcagtttatttgggttgatgttccatagtttgggctacattgattgcactaagtctaaatataaaaatttcattttatatagaattgatgttcaatggaccggactaagtttaaacatataaaaatatttaaattttgaaatatatatgtacatatacacatgtaggtcgggtaggtttaaatatagatacttacatataaatggattgggtctggttgggtcaatgcgagtctgcttaaatatatatatacatatgggctaggtcaaatcaggttagtttatatatatatatatatatgtgtatgtgtgtgtatcggatttgttggtttgcactgattttctaaaaaataaaatcgaaatcgaatcaaattttttctgttcaagagtatctcaaactaatttttaaaaaaaaaaatgatataactagatcaaaaaagaccgatttgaataggcactttatgattttgtcacttttttgtatacctctacgagcaacaataatagaaacaataataacaattgtaataatcaatataaaaattattaatagtaattaaaaaatatatacaaaatttttgcaagcattcaagtggacacaaatcaaagggcactaatgcattcataaaaggttgctagctttgatccatggtagcatcgtgtatcctgaatcatttgtaggttaattgaaacctcctaaattgcattttaaataaaaatagcatgcattttatgaagataaccttactattattaggtaataaggttgttaaattctaacctaattaatatctcctaattaagagataatagttgtggtggaaacgagatggagagaaagcacttcatctctcatctttcctctctaaataacatttcactaagagatttaattattggatcaaggctagccagtttgttatctttttttgttctagaagtgttgaccttttaccatttctcatatgaaaaaaaacattatctaagaagaataaattattatgatcatgaggagagagaaggggtgttaaggttattggattaaaatcaaactgattagaggaccttgtttgctattataaacccatgacaacaatcaatatgcactaaagttttggtataataagttatcatcaagggccaaaaaggattaactcgagaacacaagcatacaatttaacatcgtacatagataaattcaatttaggaggtaattattgatgtatatgcttagacaagaagaaagtatagaaagtaaggaaaattgcttgaatgatttagaagtgcataaatataatctaaatttgaggagtcttatttatattttgagaattagaaagggggagaaaattgaacaaaactttgataaattgattgtaagaattttcaaaccttaaagcgaaagtgatagtgaagtggaaccattaaccataatttgatattaaaaggttatctatattcattaatatcatttttttaaattattgtatatattttttgggaggaaaattatgttctttaaaagttagattggtttcgtacttatcataaatgataaatgatctgaatttagtttgaaaattatttgacatataacctttgataagaaattacatattaggattttatggtttactgtcatatagttctttgttttgtatttatttaactttgaccataaatgatttgaagtcaagatactttaattctagcctccccatcaacatgttgatggcttatgatttttattttttataacatttatttttatctataatatttttcattattaatttaatgaaagtggattacacgacatctaacttatatttttgaaaatagagaatgatatggtatactattttgaacatgttcagaaattagaatcttattattgttttcataaatttaaaatattatacttgtcaatatgaaacatattaaaaatgatctaaaatattttttaaaatttaaatgtcataggtttgaaaaattcttacttgtaaatatatgatttgtaactaaatatttttaatggcatgatattattttctaattccatcaaagatctagaacctttcaaattagttgaacttagatacgtgttttaatatgtcttaatcaagatcaacaatttgacttcttattttatatgatatatggtatattctcacttgatgcatctgtaagaaaatttaaaattcttttattttattttatatatgtgtcaatactataattcttgattatatggatttctagtacacttagattgtgattgttgtttggcattggaagatcgagacaattaataccataagtgggatatatacttgcttaacccaacattaaaccaaaatcacctctcgacaatcacacaaggacaagtgtactcaagataaacatggattgtcaagatatatataagaataataaatcatgtatataattttttttcatctacaaacttctcttctttctcttaatttagtatataacttccataccaatagattactttttatttgacccaaaaatcaatttaaccttttgtttttaatttaatcctttgtcttcttaaatgactcagcttgtaatttaaatatatcattacttatgcagtaatgtccatttgttgtaaataaatatttggcaatagaagaaatactataaggtcaaaaaatataaacaggacaatgaagcatttcgtatagtctattataaatgtagaatgaaacataataggcttttcatttgatctataattaaatataattatcaaatatcaaaattaatgtaccaatttatgagacatcaatattataaagggatactaagaaactaacgagagtacactgatcaagaaatgtgatcgaccagtgaggcatgttgtttataaattaattagacacgttttcaatttatgagaatttgtattcaaatatttataattgataaatggatcactttttatttgctctttatatttagactccaaatagtgctgtaagagaaaaaaatttgaaaaaataatttatattttcaaaaaaaatatttttatcaattttcattaccataaaaaaagatcgaaaataaaattaagaaagaatgagataagtttgataattttagacatccgcttgcataatagttcatgtttaatattaatttatcactgagaatgcaaaaatatataaaatttttaattaagctttgctacatataattattatatatcacttacataaatgatttgattaaatatttttaaaattttaatctaatttttaattgcatagatatctattgcagtaattttcctctaaataataaattaaactaagaaaataaaaaatatttaataacaattggaatatacttatcaatcctataagaataattcctgtaaaactccatccatttaacttgcatcatgcatcatttatttttttatttttaatcatttagaaatttaaaatcaaaattcaacttttatagatttattagaatgcatggaatgatttcataaatgttgcattgtactaaaagaatttatgataatctatacaagtcaagcatttaaattacttattatactttacaatagtaaactaccttttgagcaaaatggtggtaacccatcataatatgtcatatgataaataaaatgaagtacaaggctagataaagaagggggacagaaagagagatatagggctcccgagcttaagcaaccaagcaattcaatatagttgcaaccaataaaatccgatatgagcaaatataaatataactcactaaaagcccaaaatacacccaataagcccaggtaaccactagcccaaacataatggcctactaagtttgaattttaaagtttaagtctttgcccattcaccacctctaccttccaagctctaattattttaatgccattgcaaatcatcatgtcttctcttcttctaatttggtgtactatcattttcaatgtattgcaactctattgccaatcgatgctcctccaaggcatctctcaagatctcatttggctctattgcgctaccactaccatccatcctattactctctagatcaatatcaaaattaatgcagctcttttctcgatactttttgcatcatcatctcactccatcatcacagtctatacttgttatttggagcctatgcttgctactatattgtgacctcaatattacaatctctacttgttaccactcaatgtccatgcccatcttccatgaaagctacttggcaaacaatcctaataggttccaaaaaaccccacagctaaggactaaacacacaaccacacaggttctcttatactctctttatttagattcaaatctacatactaggctaagagtccaattctagtcaaactgaatcataaacatcataatcaatccatggtcaactccaaccatttatgaagcataagatcttatctaaaaaaaatcaaccaaaagttattatttggcttccttatccctatataagtatctaaatatcctttgtgtacaaccaatatcaaataaaatacatgcttgtgcggagatcctcacaaaaatatttagcaaaataatcctatcaatgttgttaggattgatgttgagtcataaatcatatatatagtggattggattagattcatcatcgatcgaattatagatcattagatctttttgaattatttaagatttttaaaatatacaagaaatgcaaaaattaaaagtataagatgaatatagaattgatgaataaagaaccaaaaaatatactgaactaaaagagagagtatgttggcttaaccaattgtagcaaggtagaaaccccactatggtatgtataacataagaaagaccgttattaaaagagaaacagatgcaaatcactttattctaagattaaaaatactatcttagctagctactttaaggatacaacttttacacattcactcacaaatcctagagatttagcaaaagagaaaagagagaaaaaagaggaaaggcaagggaagaatagttcctataatagaattttcactagttaataactcaagtatctctaggatgactacaagagtagctccaataggatatttgtaggtaatatataggaactcaattcttaaacttttcaatgtgggattccaaatttcattctaactccaataattgtaatgcaaatttttctaacaacatcaaaagttattaacaataaactcataacaattaaaacttttcaaaatttattaatatcaaactctcctaacttagacaaaaaatggatagaaaaataagtaatcataaaaaaactagttgacccaagtttataggatttgagacctatgtagcctaaacctataacccatgtggttagaacccacgatctatgttgttaggacttgcaacccgctctagcatcacatacatttaagaaatctaatttgcttccttataagttcatatatatggaatgtctaataaacaaatattgtgcctgattattcaagatctatatttgtaccatctgccaattaattatcattttatttagaatgtggttaaaaaatataaaaatttctcttttaagtccataaactccaatactatattagttaccttactaaccaagatctagaaataatttaaaatctataaaatttaatgaattatagaaattggactacataatccataatatgacattaaattctaatttcttaatagataatgattcaaagataaggtccggattgtttatggccattttatctagattgtaagatgcataacttgaatgataagattttaacaacaatagctcctattaaaaattaaaaaaatatttcttatatagttatcataaaaggtggtaatcaagtcatattatatttatcaaagcactgtctaagcaatagctacatgatactctatagtatctaagcactattctcattatctttatttctctttttaaaatttagtgagatggttgcattgcctccatctatgacttaaatttttggataacaaagccatatctattaagtttctttaatgaacatattttggctcaagtccattaggataaaaatcttttagagagcatgaaaattatatggttagaaaatgttactaaaggtgatttcatatgattcttaatgtctaaaatagtgtttaactttcttttctctatttttagtaaccaatgtcaacaaccttaatgaagcacttgaaaagatcgtctccttaataatttatattgtaagtttaaattttagttccttgaactattgataactaattgttacttcagtaactcatcaaactatttttaataattctctccatgattctcttacatgtccttttaaaatgcaacatgatatatcaatatgcttttctattagacaattcaacttctaattatgagtaattaaatatataatttttattaaaatggatctaattttttttggtttggcaactcttttgttcagcataagatcaacaattgataggtacaagaaggcatgtgccaacagttcaaactcaggtgccaccatagagattaattctcaagtaagaaagacatggcaatttaatctaaaatagatttctctgaagtccat

SEQ ID NO: 29 - protein, 9 aa, Elaeis guineensis
  MISC_FEATURE (3)..(3): Xaa is Lys or Arg
  MISC_FEATURE (4)..(7): Xaa is any amino acid
KRXXXXXKK

SEQ ID NO: 30 - protein, 8 aa, Elaeis guineensis
KRRNGLLK

SEQ ID NO: 31 - protein, 31 aa, Petunia sp.
MGRGKIEIKRIENNTNRQVTFCKRRNGLLKK

SEQ ID NO: 32 - protein, 31 aa, Elaeis guineensis
MGRGKIEIKRIENTTSRQVTFCKRRNGLLKK

SEQ ID NO: 33 - protein, 30 aa, Elaeis guineensis
  MISC_FEATURE (2)..(2): Xaa is any amino acid
  MISC_FEATURE (4)..(7): Xaa is any amino acid
  MISC_FEATURE (10)..(19): Xaa is any amino acid
  MISC_FEATURE (25)..(28): Xaa is any amino acid
RXKXXXXKRXXXXXXXXXXFCKRRXXXXKK
